United States Patent 11,624,072 (CANOLA WITH HIGH OLEIC ACID) - sequence listing, part 3

SEQ ID NO: 12785 - DNA, 336 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaaccgtccggttcacgctcggctggcctttgtacttag

SEQ ID NO: 12786 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacaccggctccctcgagagagacgaagtgttcgtccccaagaagaagtccgacatcaagtggtacggcaagtacctcaacaaccctttaggacgcaccgtgatgctaacggttcagttcacgctcggctggcctttgtacttag

SEQ ID NO: 12787 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaacagtcatcgacgccaccattccaacactggctccctcgagagagacgaagtgtttgtccccaagaagaaatccgacatcaagtggtacggaaagtacctcaacaacccgctaggacgcacggtgatgctaaccgtccaggtcacgctcggctggcatttgtacgtag

SEQ ID NO: 12788 - DNA, 415 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgagtaccagtggctggacgacaccgtcggcctcatcttccactccttcctcctcgtcccttacttctcctggaagtccgcctttgagtgagctgataccgctcgccgcagccgaacgaccgagcgcagcgagagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 12789 - DNA, 335 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttactcaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12790 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacatcgacgccaccattccaacactggctccctcgagagagacgaagtgtttgtccccaagaagaagtcagacatcaagtggtacggcaagtacctcaacatccctttgggacgcaccgtgatgttaacggttcagttcactctcggctggcctttgtacttag

SEQ ID NO: 12791 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 12792 - DNA, 329 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctttacgacaccgtcggtctcctcttccacttacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 12793 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacaaacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12794 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtcttag

SEQ ID NO: 12795 - DNA, 353 bp, Artificial
  Mutation in BnaA.FAD2.a introduced by TALE nuclease pair BnFAD2_T02
cctctcctccctcaccctctctcctacttcgcctgccatctctactcggcctgccagggctgcgtcctaaccggcgtctgggtcatagcccacgagtgcggccaccacgccttcagcgactaccagtggctggacgacaccgtcggcctcatcttccactccttcctcctcgtcccttaattctcctggacatcgacgccaccattccaacactggctccctcgagagagacgaagtgtttgtccccaagaagaaatccgacatcaagtggtacggaaagtacctcaacatcccgctaggacgcacggtgatgctaaccgtccaggtcacgctcggctggcctttgtacttag

SEQ ID NO: 12796 - DNA, 335 bp, Artificial
  Mutation in BnaA.FAD2.a introduced by TALE nuclease pair BnFAD2_T02
cctctcctccctcaccctctctcctacttcgcctggcctctctactggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12797 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12798 - DNA, 350 bp, Artificial
  Mutation in BnaA.FAD2.a introduced by TALE nuclease pair BnFAD2_T02
cctctcctccctcaccctctctcctacttcgcctggcctatctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 12799 - DNA, 329 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccacttacagtcatcgacgccaccattccaacactggctccctcgagagagacgaagtgtttgtccccaagaagaagtcagacatcaagtggtacggaaagtacctcaacaacccgcgaggacgcacggtggtgctaaccgtccagttcacgctcggctggcctttgtacttag

SEQ ID NO: 12800 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 12801 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 12802 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaacccttttggacgcaccgtgatgttaacggttcagttcactctcggctggcctttgtacttag

SEQ ID NO: 12803 - DNA, 362 bp, Artificial
  Mutation in BnaA.FAD2.a introduced by TALE nuclease pair BnFAD2_T02
cctctcctccctcaccctctctactacttcgcctggcatctctactgggcctgccagggctgcgtcctaaccggcgtctgggtcatagcccacgagtgcggccaccacgccttcagcgactaccagtggctggacgacaccgtcggcatcatcttccactccttcctcctcgtcccttacttctcctggaagtaacagccatcgacgccaccattccaacaccggatccctcgagagggatgaagtgttcgtccccaagaagaaatccgacatcaagtggtacggagagtacctcaacaacccgctgggacgcacggtaatgctaatcgtggagttcacgctcgtctggccggtatacttag

SEQ ID NO: 12804 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12805 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 12806 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaaagccatcgacgccaccattccaacaccggatccctcgagagagacgaagtgtttgtccccaagaagaagtcagacatcaagtggtacggcaagtacctcaacaaccctttgggacgcaccgtgatgttaacgtttcagttcactctcggctggcctttgtacttag

SEQ ID NO: 12807 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12808 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12809 - DNA, 363 bp, Artificial
  Mutation in BnaA.FAD2.a introduced by TALE nuclease pair BnFAD2_T02
cctctcctccctcaccctctctcctgcttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaagttggttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12810 - DNA, 473 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggccatcgcccacgaatgcggccaccacgccttcagcgaccaccagtggctggacgacgccgtgggcctcgtcttccactccttcctcctcgtcccttacttctccacggcttgaccccggagcaggtggtggccatcgccagccacgatggcggcaagcaggcgctggagacggtccagcggctgttgccggtgctctgccaggcccacggcttgaccccccagcaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12811 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagcagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 12812 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcttttgtactta

SEQ ID NO: 12813 - DNA, 393 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcggcccttacttctcctggaagtacaacactggctccctcgagagagacgaagtgtttgtcatcgacgccaccattccaacactggctccctcgagagagacgaagtgtttgtccccaagaagaagtcagacatcaagtgttacggcaagtacctcaacatccctttgggacgcaccttggtgttaacggttcagttcactctcggctggcctttgtacttag

SEQ ID NO: 12814 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtccttag

SEQ ID NO: 12815 - DNA, 444 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggaagtacaagccgtgggcctggcacagcaccggcaacagccgctggaccgtctccagagaagtaatctgctgtttgcaaacaaaaaaaccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12816 - DNA, 339 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccaccatttcaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12817 - DNA, 453 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacgatgttccagattacgctatcgatatcgccgagctacgcacgctcggctacagccagcagcaacaggcgaagatcaaaccgaaggttcgttcgagtcatcgacgccaccattccaacactggctccctcgagagagacgaagtgtttgtcccaagaagaagtcagacatcaagtggtacggcaagtacctcaacaaccctttgggacgcaccgtgatgttaacggttcagttcactctcggctggcctttgtacttag

SEQ ID NO: 12818 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12819 - DNA, 350 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12820 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaaccgttcagttcacgctcggctggcctttgtacttag

SEQ ID NO: 12821 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttccgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12822 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagggatgaagtgttcgtccccaagaagaaatccgacatcaagtggtacggaaagtacctcaacaacccgctaggacgcacggtgatgctaaccttccagttcacgctcggctggcctttgtacttag

SEQ ID NO: 12823 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtaccgcaacaaccctttgggacgcaccgtgatgttaacgtttcagtgctctctcggctggccgttgtacttag

SEQ ID NO: 12824 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggaaagtacctcaacaaccctttgggacgcaccgtgatgttaacggttcagttcactctcggctggcctttgtacttag

SEQ ID NO: 12825 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 12826 - DNA, 357 bp, Artificial
  Mutation in BnaA.FAD2.a introduced by TALE nuclease pair BnFAD2_T02
catctcctccctcaccctctctcctacttcgcctggcctctctactgggcctgccagggctgcgtcctaacgggcctctgggtcatcgcccacgaatgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccggtgggacgcaccgtgatgttaacggttcagttcactctcggctggcctgtgtacttag

SEQ ID NO: 12827 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtaccccaacaccccttagggacgcaccgtgatgtcaacggttcagttccctctcggctggcctttgtacttag

SEQ ID NO: 12828 - DNA, 354 bp, Artificial
  Mutation in BnaA.FAD2.a introduced by TALE nuclease pair BnFAD2_T02
cctctcctccctcaccctctgtcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctgtgggacgcaccgtgatgttaacggttcagtgcactctcggcttgccttggtacttag

SEQ ID NO: 12829 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12830 - DNA, 348 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggaacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctgagtacttag

SEQ ID NO: 12831 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12832 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgctaaccgtccagttcacgctcggctggcctttgtacttag

SEQ ID NO: 12833 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgatcggctggcctttgtacttag

SEQ ID NO: 12834 - DNA, 407 bp, Artificial
  Mutation in BnaA.FAD2.a introduced by TALE nuclease pair BnFAD2_T02
ctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaccgtcgctgtcaagtatcaggacatgatcgcagcgttgccagaggcgacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12835 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12836 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 12837 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgtcctttgtacttag

SEQ ID NO: 12838 - DNA, 355 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgtttgtccccaagaagaagtcagacatcaagtggtacggcaagtacctcaacaacccttggggacgcaccgtgatgttaacggttcagttcactctcggctggcctttgtacttag

SEQ ID NO: 12839 - DNA, 353 bp, Artificial
  Mutation in BnaA.FAD2.a introduced by TALE nuclease pair BnFAD2_T02
cctctcctccctcaccctctctcctacttcgcctggactctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctgttcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggccgtggtacttag

SEQ ID NO: 12840 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccctacttctcctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12841 - DNA, 415 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtccgcctttgagtgagctgataccgctcgccgcagccgaacgaccgagcgcagcgagagtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 12842 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 12843 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12844 - DNA, 321 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggaagagagagacgaagtgtttgtccccaagaagaagtcagacatcaagtggtacggcaagtacctcaacaaccctttgggacgcaccgtgatgttaacggttcagttcactctcggctggcctttatacttag

SEQ ID NO: 12845 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 12846 - DNA, 346 bp, Artificial
  Mutation in BnaA.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggagcaggcaatccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12847 - DNA, 352 bp, Artificial
  Mutation in BnaA.FAD2.a introduced by TALE nuclease pair BnFAD2_T02
cctctcctccctcaccctctctcctacttcgcctggccactctactggtcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcgacgccaccattccaacaccggatccctcgagagggatgaagtgttcgtccccaagaagaagtcagacatcaagtggtacggcaagtacctgaacacccctgtgggacgcaccgggctgttacccgtccagctcactctcggctggcctttgtacttag

SEQ ID NO: 12848 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 12849 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgttctaaccggcgtctgggtcatagcccacgagtgcggccaccacgccttcagcgactaccagtggctggacgacaccgtcggcctcgtcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12850 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactcattcctcctcgtcatcgacgccaccattccaacactggctccctcgagagagacgaagtgtttgtccccaagaagaagtcagacatcaagtggtacggcaagtacctcaacagccctttgggacgcaccgtgatgttaacggtgcagttcactctcggctggactatgtacttag

SEQ ID NO: 12851 - DNA, 306 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 12852 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttacactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12853 - DNA, 354 bp, Artificial
  Mutation in BnaA.FAD2.a introduced by TALE nuclease pair BnFAD2_T02
ctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatggtaacggttcagttcactctcggctggcctttgtacttag

SEQ ID NO: 12854 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12855 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 12856 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttactaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12857 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttaatcgtgtcatcgacgccaccattccaacactggctccctcgagagagacgaagtgtttgtccccaagaagaagtcagacatcaagtggtacggcaagtacctcagcaacccttggggacgcgccgtgatgttaacggttcatttcgctcgcggctggcctgtgtacgtag

SEQ ID NO: 12858 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagccgacgagtgcggccaccacgccttcagcgactaccagtggctggacgacaccgtcggcctcatcttccactccttcctcctcgtcccttacttctcctggaaagtcatcgacgccaccattccaacactggctccctcgagagggatgaagtgttcgtccccaagaagaaatccgacatcgagtggtacggaaagtacctcaacagcccgctaggacgcgcggtgatgctaaccgtccagtgcacgctcggctggcctttgtacttag

SEQ ID NO: 12859 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12860 - DNA, 321 bp, Artificial
  Mutation in BnaA.FAD2.a introduced by TALE nuclease pair BnFAD2_T02
cctctcctccctcaccctctcccttacctcgcctggcacctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagagagacgaagtgtttgtccccaagaagaagtcagacatcaagtggtacggcaagtacctcaacaaccctttgggacgcaccgtgatgttaacggttcagttcactctcggctggccttagtacttag

SEQ ID NO: 12861 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 12862 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggatcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 12863 - DNA, 319 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 12864 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12865 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaacccttttggacgcaccgtgatgttaacggttcagttcactctcggctggcctttgtacttag

SEQ ID NO: 12866 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgaccaccagtggctggacgacgccgtgggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctgtgggacgcaccgtgaggttaacggttcagttcactctcggctggccgttgtacttag

SEQ ID NO: 12867 - DNA, 312 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 12868 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgaatgcggccaccacgccttcagcgaccaccagtggctggacgacgccgtgggcctcgtcttccactccttcctcctcgtcccttacttctcctggaactcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12869 - DNA, 358 bp, Artificial
  Mutation in BnaA.FAD2.a introduced by TALE nuclease pair BnFAD2_T02
cctctcctccctcaccctctctcctacttcgcctggcctctctactgagcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgtcctttgtacttag

SEQ ID NO: 12870 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggctggacgacaccgtcggcctcatcttccactccttcctcctcgtcccttacttctcctggaaagtcattgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12871 - DNA, 356 bp, Artificial
  Mutation in BnaA.FAD2.a introduced by TALE nuclease pair BnFAD2_T02
cctctcctccctcaccctctcccttacctcgcctggcccctctactaggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaattcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12872 - DNA, 415 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatagcgagtcagtgagcgaggaagcggaagagcgcccaatacgcaaaccgcctctcagtcatcgacgccaccattccaacactggctacctcgagagagacgaagtgtttgtccccaagaagaagtcagacatcaagtggtacggcaagtacctcaacaaccctgtgggacgcaccgggatgttaacggttcagttcactctcggctggcctttgtacttag

SEQ ID NO: 12873 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 12874 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaaatccgacatcaagtggtacggaaagtacctcaacaaccctttgggacgcaccgtgatgttaacggttcagttcactctcggctggcctttgtacttag

SEQ ID NO: 12875 - DNA, 349 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttccgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12876 - DNA, 291 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgccaccattccaacactggctccctcgagagagacgaagtgtttgtccccaagaagaagtcagacatcaagtggtacggcaagtacctcaacaaccctttgggacgcaccgtgatgttaatggttcagttcactctcggctggcctttgtacttag

SEQ ID NO: 12877 - DNA, 340 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 12878 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctccggaagtacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 12879 - DNA, 358 bp, Artificial
  Mutation in BnaA.FAD2.a introduced by TALE nuclease pair BnFAD2_T02
cctctcctccctcaccctctctccaacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12880 - DNA, 442 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggagcaggtggtggccatcgccagcaatggcggtggcaagcaggcgctggagacggtccagcggctgttgccggtgctgtgccaggcccagtcatcgacgccaccattccaacactggctccctcgagagagacgaagtgtttgtccccaagaagaaatccgacatcaagtggtacggaaagtacctcaacaacccgctaggacgcacggtgaggctaaccgtccagttcacgctcggctggcctttgtacttag

SEQ ID NO: 12881 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactatcggctggcctttgtacttag

SEQ ID NO: 12882 - DNA, 346 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggagccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12883 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12884 - DNA, 454 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctgacggtccagcggctgttgccggtgctgtgccaggcccacggcttgaccccccagcaggtggtggccatcgccagcaatggcggtggcaagcaggcgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12885 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12886 - DNA, 355 bp, Artificial
  Mutation in BnaA.FAD2.a introduced by TALE nuclease pair BnFAD2_T02
cctctcatccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggaagtatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12887 - DNA, 318 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12888 - DNA, 345 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcttcccttacttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12889 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12890 - DNA, 353 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccttgtcatcgacgccaccattccaacactggctacctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 12891 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcctcttccactccttcctcctcgtcccttacttctcctggaagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 12892 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcagttggacttag

SEQ ID NO: 12893 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttgtcatcgacgccaccattccaacactggctccctcgagagagacgaagtgtttgtccccaagaagaagtcagacatcaagtggtacggcaagtacctcaataaccctttgggacgcaccgtgatgttaacggttcagttcactctcggctggcctttgtacttag

SEQ ID NO: 12894 - DNA, 357 bp, Artificial
  Mutation in BnaA.FAD2.a introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12895 - DNA, 445 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtgtgtgcacgaaccccccgttcagcccgaccgctgcgccttataggggataacgcaggaaagaacatgtgagcaaaaggccagcaaacgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12896 - DNA, 407 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacggtgctgttccgggcgatctcgatcagctcgatgtactcgtgggacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcatttgtacttag

SEQ ID NO: 12897 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctccttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12898 - DNA, 392 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggagactgagcctttcgttttatctgttgtttgtcggtgaacgctcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 12899 - DNA, 339 bp, Artificial
  Mutation in BnaA.FAD2.a introduced by TALE nuclease pair BnFAD2_T02
ccttcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcttccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12900 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccttcatcgacgccaccattccaacactggctccctcgagggagacgaagtgtttgtccccaagaagaagtcagacatcgagtggtacggcaagtacctcaacaaccctttgggacgcaccgtgatgttaacggttcagttcactcgcggctggcctgtgtacttag

SEQ ID NO: 12901 - DNA, 349 bp, Artificial
  Mutation in BnaA.FAD2.a introduced by TALE nuclease pair BnFAD2_T02
cctctcctccctcaccctctctcctacttcgcctggcttctctactgggcctgccagggctgcgtcctaaccggcgtctgggtcatagcccacgagtgcggccaccacgccttcagcgactaccagtggctggacgacaccgtcgacctcatcttccactccttcctcctcgtcccttaatcgtgtcatcgacgccaccattccaacaccggatccctcgagagtgatgaagtgttcgtccccaagaagaaatcccacatcaagtggtacggaaactacctcaacatcccgctagaacgcccggtgatgcaaaccggccaatgcacgctcgggtggccttggtacttag

SEQ ID NO: 12902 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaaatccgacatcaagtggtacggaaagtacctcaacagcccgctaggacgcgcggtgatgctaaccgtccagttcacgctcggctggccgtggtccttag

SEQ ID NO: 12903 - DNA, 385 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctcgtcttccactccttcctcctcgtcccaatacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12904 - DNA, 357 bp, Artificial
  Mutation in BnaA.FAD2.a introduced by TALE nuclease pair BnFAD2_T02
cctctcctcctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 12905 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 12906 - DNA, 356 bp, Artificial
  Mutation in BnaA.FAD2.a introduced by TALE nuclease pair BnFAD2_T02
cctctcctccctcaccctctcccctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12907 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggcgcgtcctaaccggcgtctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctgtgtgacgcaccgtgatgttaacggttcagttcactctcggctggcctttgtacttag

SEQ ID NO: 12908 - DNA, 356 bp, Artificial
  Mutation in BnaA.FAD2.a introduced by TALE nuclease pair BnFAD2_T02
cctctactccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12909 - DNA, 312 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12910 - DNA, 318 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12911 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12912 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccacaagaagaagtcagacatcaagtggtacggcaagtacctcaacaaccctttgggacgcaccgtgatgttaacggttcagttcactctcggctggcctttgtacttag

SEQ ID NO: 12913 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgtgacgcaccgtgatgttaacggttcatttcactctcggctggcctgtgtacttag

SEQ ID NO: 12914 - DNA, 359 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12915 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 12916 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12917 - DNA, 350 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggtctcatcttccactcctttctcctcgtcccttactcctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12918 - DNA, 393 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacaacactggctccctcgagagagacgaagtgtttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12919 - DNA, 358 bp, Artificial
  Mutation in BnaA.FAD2.a introduced by TALE nuclease pair BnFAD2_T02
cctctcctccctcaccctctcacttacctcgcctggcacctctactgggcctgccaaggctgcgtcctaacgggcctctgggtcatcgcccacgaatgcggccaccacgccttcagcgaccaccagtggctggacgacgccgtgggcctcgtctaccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacgtttcagttcactctcggctggcctttgtacttag

SEQ ID NO: 12920 - DNA, 391 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcatcttccactccttccaccaccagcaatatttgtggcaagcaggcgctggagacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 12921 - DNA, 343 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttactatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12922 - DNA, 355 bp, Artificial
  Mutation in BnaA.FAD2.a introduced by TALE nuclease pair BnFAD2_T02
cctctcctccctcaccctctatcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12923 - DNA, 349 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttaatcgtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12924 - DNA, 367 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacacacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12925 - DNA, 437 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaccgtctccagcggctgttgccggtgctgtgccaggcccacggcttgaccccggagcaggtggtggccatcgccatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgccctttgtacttag

SEQ ID NO: 12926 - DNA, 364 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgaccaccagtggctggacgacgccgtgggcctcgtcttccactccttcctcctcgtcccttacttctcctggaagtacaaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactag

SEQ ID NO: 12927 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtaccgcaacaacccttggggacgcgccgtgatgttaacggttcatttcactctcggctggcctgtgtacttag

SEQ ID NO: 12928 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12929 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 12930 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12931 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaattacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12932 - DNA, 340 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcccaccattccaacaccggatccctcgatagggacgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 12933 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagttcctcaacaaccctttggaacgcaccgtgatgttaacggttcagttgccgctcggctggcctcagtacttag

SEQ ID NO: 12934 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtcttggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12935 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12936 - DNA, 360 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12937 - DNA, 310 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtcatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 12938 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcgacgccaccattccaacactggctccctcgagagagacgaagtgtttgtccccaagaagaagtcagacatcaagtggtacggcaagtaccgcaacaaccctttgggacgcaccgtgatgttaacggttcagttcactctcggctggcctttgtacttag

SEQ ID NO: 12939 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatagacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12940 - DNA, 346 bp, Artificial
  Mutation in BnaA.FAD2.a introduced by TALE nuclease pair BnFAD2_T02
cctctcctccctcaccctctctcctacttcgcctggcctctctactgggcctgccatggctgcgtcctaaccggcgtctgggtcatagcccacgagtgcggccaccacgccttcagcgactaccagtggctggacgacaccgtcggcctcatcttccactccttcctcctcgtcccttacttctcctggcgccaccattccaacactggctccctcgagagagacgaagtgtttgtccccaagaagaagtcagacatcaagtggtacggcaagtacctcaacaaccctttgggacgcaccgtgatgttaacggttcatttcactctcggctggcctttgtacttag

SEQ ID NO: 12941 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacgtag

SEQ ID NO: 12942 - DNA, 318 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagacgaagtgtttgtccccaagaagaagtcagacatcaagtggtacggcaagtacctcaacaacccgttgtgacgcaccgtgatgttaacgggtcagttcactctcggctggcctgtgtacttag

SEQ ID NO: 12943 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 12944 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12945 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctgaacgacgccgtgggcctcgtcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12946 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12947 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccgtcgtctgggtcatagcccacgagtgcggccaccacgccttcagcgactaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 12948 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatatcgacgccaccattccaacactggctccctcgagagagacgaagtgtttgtcccaaagaagaagtcagacatcaagtggtacggcaagtacctcaacaaccctttgggacgcaccgggatgttaacggttcagttcactctcggctggcctttgtacttag

SEQ ID NO: 12949 - DNA, 434 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatggcggcaagcaggcgctggagacggtccagcggctgttgccggtgctgtgccaggcccacggcttgaccccccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12950 - DNA, 360 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12951 - DNA, 360 bp, Artificial
  Mutation in BnaA.FAD2.a introduced by TALE nuclease pair BnFAD2_T02
cctctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12952 - DNA, 329 bp, Artificial
  Mutation in BnaA.FAD2.a introduced by TALE nuclease pair BnFAD2_T02
cctctcctccctcaccctctcccttacctcgcctggccactctactgggcctgccaaggctgcgtcctaacgggcctctgggtcatagcccacgagtgcggccaccacgccttcagcgactacaagtggctggacgacaccgtcggcctcatcttccactaccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12953 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacatcgacgccaccattccaacactggctccctcgagagagacgaagtgtttgtccccaagaagaaatccgacatcaagtggtacggaaagtacctcaacaaccctttgggacgcaccgtgatgttaacggttcagttcactctcggctggcctttgtacttag

SEQ ID NO: 12954 - DNA, 341 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12955 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtagctcaacatcccttggggacgcaccgtgatgtgaacggttcagttcactctaggctggcctttgtacttag

SEQ ID NO: 12956 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgccctttgtacttag

SEQ ID NO: 12957 - DNA, 357 bp, Artificial
  Mutation in BnaA.FAD2.a introduced by TALE nuclease pair BnFAD2_T02
cctctcctccctcaccctctcctttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12958 - DNA, 310 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggcttgacgacaccgtcggtctcatcttccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 12959 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtccggcaagtacctcaacaaccctttgggacgcaccgtgatgttaacggttcagttcactctcggctggcctttgtacttag

SEQ ID NO: 12960 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgtaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12961 - DNA, 291 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12962 - DNA, 349 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttccgtcatcgacgccaccattccaacactggctccctcgagagagacgaagtgtttgtccccaagaagaagtcagacatcaagtggtacggcaagtaccgcaacaaccctttgggacgcaccgtgatgttaacggttcagttcactctcggctggccgttgtacttag

SEQ ID NO: 12963 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcgtcttccactccttcctcctcgtcccttacttctcctggaagtgccaccattccaacactagctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12964 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 12965 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggcgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagccatcaagtgatacggcaagtacctcaacaaccccgtgagacgcgccgtgatgtcagcggttcagttcactctcggctggcctttgtccttag

SEQ ID NO: 12966 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12967 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaacactttgggacgcaccgtgatgttaacggttcagttcacgctcggctggcctttgtacttag

SEQ ID NO: 12968 - DNA, 357 bp, Artificial
  Mutation in BnaA.FAD2.a introduced by TALE nuclease pair BnFAD2_T02
cctctcctccctcaccctctatcctacttcgcctggcctctctactgggcctgccagggctgcgtcctaaccggcgtctgggtcatagaccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacggaccgtgatgttaacggttcagtgcacgctcggcttgtctctgtgcttag

SEQ ID NO: 12969 - DNA, 339 bp, Artificial
  Mutation in BnaA.FAD2.a introduced by TALE nuclease pair BnFAD2_T02
cctctcctccctcaccctctcccttacctcgcctggcccatctactgggcctgccaaggctgcgtcctaacgggcctctgggtcatcgcccacgaatgcggccaccacgccttcagcgaccaccagtggctggacgacgccgtgggcctggcacagcaccggcaacagccgctagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12970 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcaggcatcaagtggtacggcaagtacctcaacaaccctttgggacgcaccgtgatgttaacggttcagttcactctcggctggcctttgtacttag

SEQ ID NO: 12971 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 12972 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaacatcgacgccaccattccaacactggctccctcgagagagacgaagtgtttgtccccaagaagaagtcagacatcaagtggtacggcaagtacctcaacaccccttagggacgcaccgtgatgttaacggttcagttcactctcggctggcctttgtacttag

SEQ ID NO: 12973 - DNA, 324 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccgacgtctgggtcatagcccacgagtgcggccaccacgccttcagcgactaccagtggctggacgacgccgtgggcctcgtcttccactccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 12974 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12975 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttccgtcatcgacgccaccattccaacactggctccctcgagagagacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 12976 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaacatcgacgccaccattccaacactggctccctcgagagagacgaagtgtttgtccccaagaagaagtcagacagcaagtggtacggcaagtacctcaacaaccctttgggacgcaccgggatgttaacggttcagttcactctcggctggcttggtacttag

SEQ ID NO: 12977 - DNA, 345 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12978 - DNA, 391 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaggatctagatgtattcgacgcgagagtagggtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12979 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacatcgacgccaccattccaacactggctccctcgagagagacgaagtgtttgtccccaagaagaagtcagacatcaagtggtacggcaagtacctcaacaaccctctgggacgcaccgtgatgttaacggttcagttcactctcggctggcctttgtacttag

SEQ ID NO: 12980 - DNA, 340 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgtggccaccacgccttcagcgactaccagtggctggacgacaccgtcggcctcatcttccactccttcctcctcgtccctcatcgacgccaccattccaacactggctccctcgagagagacgaagtgtttgtctccaagaagaagtcagacatcaagtggtacggcaagtacctcaacaaccctttgggacgcaccgtgatgttaacggttcagttcactctcggctggcctttgtacttag

SEQ ID NO: 12981 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggattcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggccgttgtacttag

SEQ ID NO: 12982 - DNA, 346 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 12983 - DNA, 329 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactaccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12984 - DNA, 319 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12985 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagcatcgacgccaccattccaacactggctccctcgagagagacgaagtgtttgtccccaagaagaaatcagacatcaagtggtacggcaagtacctcaacaaccctttgggacgcaccgtgatgttaacggttcagttcactctcggctggcctttgtacttag

SEQ ID NO: 12986 - DNA, 353 bp, Artificial
  Mutation in BnaA.FAD2.a introduced by TALE nuclease pair BnFAD2_T02
cctctcctccctcaccctctctcctacttcgcctggactctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12987 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcatacatcaagtggtacggaaagtacctcaacaacccgctaggacgcacggtgatgctaaccgtccagttcacgctcggctggccgttgtacttag

SEQ ID NO: 12988 - DNA, 419 bp, Artificial
  Mutation in BnaA.FAD2.a introduced by TALE nuclease pair BnFAD2_T02
cctctcctccctcaccctctctactacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacattccgtggcgttatccagctaagcgcgaactgcaatttggagaatggcagcgcaatgacacatcgacgccaccattccaacactggctccctcgagagagacgaagtgtttgtccccaagaagaaatccgacatcaagtggtacggaaagtacctcaacaacccgctaggacgcacggtgatgctaaccgtccagtgcacgctcggctggccgttggacttag

SEQ ID NO: 12989 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttccgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12990 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12991 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgtgggacgcgccgtgatgttaacggttcagttcactctcggcgggccttggtacttag

SEQ ID NO: 12992 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12993 - DNA, 412 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggaagtgcacagcaccggcaacagccgctgggccaggaaccgtaaaaaggccgcgttgcagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12994 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 12995 - DNA, 331 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgaatgcggccaccacgccttcagcgactaccagtggcttgacgacaccgtcggtctcatcttccactccttcctccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12996 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 12997 - DNA, 345 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcgtctgggtcatagcccacgagtgcggccaccacgccttcagcgactaccagtggctggacgacaccgtcggcctcatcttccactccttcctcctcgtcccttacttctcctattccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 12998 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggactctgggtcatcgcccacgaatgcggccaccacgccttcagcgactaccagtggcttgacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctgtgtacttag

SEQ ID NO: 12999 - DNA, 383 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagactgagcctttcgttttatttgatgcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13000 - DNA, 356 bp, Artificial
  Mutation in BnaA.FAD2.a introduced by TALE nuclease pair BnFAD2_T02
cctctcctccctcaccctctctcctacttctcctggcctctctactgggcctgccagggctgcgtcctaaccggcgtctgggtcatcgcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtccggcaagtaccccaacaccccagtgggacgcaccataaggttaacggttcctttcactctcggctggcctttgtacttag

SEQ ID NO: 13001 - DNA, 357 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggctggcctttgtacttag

SEQ ID NO: 13002 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13003 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctaggctggcctttgtacttag

SEQ ID NO: 13004 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13005 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggccgttgtacttag

SEQ ID NO: 13006 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtaccccaacaaccctttgggacgcaccgtgatgttaacggttcagttcactctcggctggccttggtacttag

SEQ ID NO: 13007 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 13008 - DNA, 363 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacacagtcatcgacgccaccattccaacactggctccctcgagagagacgaagtgtttgtccccaagaagaagtcaaacatcaagtggtacggcaagtacctcaacaaccctttgggacgcgccgtgatgttaacggttcagttcactctcggctggcctttgtacttag

SEQ ID NO: 13009 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcttagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13010 - DNA, 387 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtccctttgcctggcacagcaccggcaacagccgctggaccgtctccagctgtcatcgacgcaaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 13011 - DNA, 354 bp, Artificial
  Mutation in BnaA.FAD2.a introduced by TALE nuclease pair BnFAD2_T02
cctctcctccctcaccctctctcctacttcgccttgcctctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggatcatcgacgccaccattccaacacttgctccctcgagagagacgaagtgtttgtccccaagaagaagtcagacatcaagtggtacggcaagtacctcaacaaccctttgggacgcatcgtaatgttaacggttccgttcactctcggctggcctttgtacttag

SEQ ID NO: 13012 - DNA, 315 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcatctacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13013 - DNA, 358 bp, Artificial
  Mutation in BnaA.FAD2.a introduced by TALE nuclease pair BnFAD2_T02
cctctcctccctcaccctctcccttacctcgcctggcacctctactgggcctgccagggctgcgtcctaaccggcgtctgggtcatagcccacgagtgcggcaaccacgccttcagcgactaccagtggctggacgacaccgtcggcctcatcttacactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13014 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtctgcctcatcttccactccttcctcctcgtcccttacttctcctggaaaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13015 - DNA, 341 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcccggctggcctttgtacttag

SEQ ID NO: 13016 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13017 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 13018 - DNA, 359 bp, Artificial
  Mutation in BnaA.FAD2.a introduced by TALE nuclease pair BnFAD2_T02
cctctcctccctcaccctctctcctacttcgcctagcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacatccctttgggacgcaccgtgatgttaacggttcagttcactctcggctggcctgtgtacttag

SEQ ID NO: 13019 - DNA, 389 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatggtggccatcgccagcaatggcggtgacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13020 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13021 - DNA, 358 bp, Artificial
  Mutation in BnaA.FAD2.a introduced by TALE nuclease pair BnFAD2_T02
cctctcctccctcaccctctctcctacttcgcctggcctctctactgggcctgtcagggctgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13022 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagatgtcagacatcaagtggtacggcaagtacctcaacaacccgctaggacgcacggtgatgctaaccgtccagttcacgctcggctggcctttgtacttag

SEQ ID NO: 13023 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtaaggcacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13024 - DNA, 385 bp, Artificial
  Mutation in BnaA.FAD2.a introduced by TALE nuclease pair BnFAD2_T02
cctctcctccctcaccctctcccttacctcgcctggcccctctactgggcctgccacggctgcgtcctaacgggcctctgggtcatcgcccacgaatgcggccaccacgccttcagcgaccaccagtggccggacgacgccgtgggcctcgtcttccactccttcctcctcgtcccttacttctcctcgtcttccactccttcctcctcgtcccaatacagccatcgacgccaccattccaacactggctccctcgagagagacgaagtgtttgtccccaagaagaagtcagacatcaagtggtacggcaagtacctcaacaaccctgtgggacgcaccgggatgttaacgtttcagttcacgctcggctggcctttgtacttag

SEQ ID NO: 13025 - DNA, 454 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtacgatgttccagattacgctatcgatatcgccgatctacgcacgctcggctacagccagcagcaccatgagaagatcaaaccgaagcttcgttcgagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13026 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 13027 - DNA, 336 bp, Artificial
  Mutation in BnaA.FAD2.a introduced by TALE nuclease pair BnFAD2_T02
cctctcctccctcaccctctcccttacctcgcatggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagactaagtgtttgtccccaagaagaagtcagacatcaagtggtacggcaagtacctcaacaccccttcgggacgcaccgtgatgttaacggttcagttcactctcggcttgcctttgtacttag

SEQ ID NO: 13028 - DNA, 447 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggttggacgacaccgtcggcctcatcttccactccttcctcctcgtcccttacttctcctggaagcaatgacattcttgcaggtatcttcgagccagccacgatcgacattgatctggctatcttgctgacaaaagcaagagaacatagcgttgcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13029 - DNA, 318 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggcctcatcttccactccttcctcctcgtcccttacttctcctggagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13030 - DNA, 355 bp, Artificial
  Mutation in BnaA.FAD2.a introduced by TALE nuclease pair BnFAD2_T02
cctctcctccctaaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 13031 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13032 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcactctcggctggcctttgtacttag

SEQ ID NO: 13033 - DNA, 356 bp, Artificial
  Mutation in BnaA.FAD2.a introduced by TALE nuclease pair BnFAD2_T02
cctctcctccctcaccctctcccttacctcgcctggctcctctactgggcctgccagggctgcgtcctaaccggcgtctgggtcatagcccacgagcgcggccaccacgccttcagcgactaccagtggctggacgacaccgtcggcctcatcttccactccttcctcctcgtcccttacttctcctggaagtcatcgacgccaccattccaacactggctccctcgagagagacgaagtgcttgtccccaagaagaagtcagacatcaagtggtacggcaagtagctcaacaacccgctaagacggacggtggggcaaaccgcccggttcacgctcggctggccttagtacttag

SEQ ID NO: 13034 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13035 - DNA, 344 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacattccaacactggctccctcgagagagacgaagtgtttgtccccaagaagaagtcagacatcaagtggtacggcaagtacctcaacaaccctttgggacgcaccgtgatgttaacggttcagttcactctcggctggccttgtacttag

SEQ ID NO: 13036 - DNA, 318 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13037 - DNA, 332 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtggctccctcgagagagacgaagtgtttgtccccaagaagaagtcagacatcaagtggtacggcaagtacctcaacacccctgtgggacgcaccgtgatgttaacggttcagttcactctcggctggcctttgtacttag

SEQ ID NO: 13038 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13039 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggctggcctttgtacttag

SEQ ID NO: 13040 - DNA, 321 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgtagaaacgcaaaaaggccatccgtcaggatggccttctgcttagtcagtcatcgacgccaccattcaaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13041 - DNA, 356 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttgtacttag

SEQ ID NO: 13042 - DNA, 409 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaccttgaccgaacgcagcggtggtaacggcgcagtggcggttttcatggcttgagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13043 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggccgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatttaacggttcagttcactctcggctggcctttgtacttag

SEQ ID NO: 13044 - DNA, 419 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacattccgtggcgttatccagctaagcgcgaactgcaatttggagaatggcagcgcaatgacacatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 13045 - DNA, 358 bp, Artificial
  Mutation in BnaA.FAD2.a introduced by TALE nuclease pair BnFAD2_T02
cctctcccccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13046 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13047 - DNA, 357 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13048 - DNA, 352 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13049 - DNA, 413 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtacaatggccaccacctgctggggggtcaagccgtgggcctggcacagcaccggcagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 13050 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcaggcatcaagtggtacggcaagtacctcaacaaccctttgggacgcaccgtgatgttaacggttcagttcactctcggctggcctttgtacttag

SEQ ID NO: 13051 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13052 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaacatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 13053 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13054 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttccttctcgtcccttacttctcctggaagtcatcgacgccaccattccaacactggatccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 13055 - DNA, 441 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagctcggtttgatcgacagtggcgcagcaccacgaggcactggtcggccacgggtttacacacgcgcacatcgtcgcgttaatccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13056 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13057 - DNA, 355 bp, Artificial
  Mutation in BnaA.FAD2.a introduced by TALE nuclease pair BnFAD2_T02
cctctcctccctcaccctctctcctacttcgcctttcctctctactgggcctgcccagggtgcgtcctaaccggcctctgggtcatagcccacgcttgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcacgtatctcaacaaccctttgagacgcacagtggtcttaacggctcagttcactctcggctggcctttgtacttag

SEQ ID NO: 13058 - DNA, 443 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgcgatggccaccacctgctggggggtcaagccgtgggcctggcacagcaccggcaacagccgctggaccgtctccagcgcctgcttgtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13059 - DNA, 360 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacgtcatcgacgccaccattccaacactggctccctcgagtgagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13060 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13061 - DNA, 408 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagcctttcgttttaattgatgcctggcagttccctattctcgtgttgaatacagccatcgacgccaccattccaacactggctccctcgagagagacgaagtgtttgtccccaagaagaagtcagacatcaagtggtacggcaagtacctcaacaaccatttggaacgcaccgtgatgttaacggttcagttcactctcggctggcctttgtacttag

SEQ ID NO: 13062 - DNA, 291 bp, Artificial
  Mutation in BnaA.FAD2.a introduced by TALE nuclease pair BnFAD2_T02
cctctcctccctcaccctctctactacttcgcctggcctctctactgggcctgccagggctgcgtcctaaccggcgtctgggtcatagcccacgagtgcggccaccacgccttcagcgactaccagtggcttgacgacaccattccaacactggctccctcgagagagacgaagtgtttgtccccaagaagaagtcagacatcaagtggtacgacaagtacctcaacaaccctttgggacgcaccgtgatgttaacgggtcagttcactctcggctggcctttgtacttag

SEQ ID NO: 13063 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13064 - DNA, 357 bp, Artificial
  Mutation in BnaA.FAD2.a introduced by TALE nuclease pair BnFAD2_T02
cctctcctccctcaccctctctcctacttcgcctggcctctccactgggcctgccagggctgcgtcctaaccggcgtctgggccatagcccacgaatgcggccaccacgccttcagcgactaccagtggctggacgacaccgtcggcctcatcttccactccttcctcctcgtcccttacttctcctggaaagtcatcgacgccaccattccaacactggctccctcgagagagacgacgtgtttgtccccaagaagaagtcacacatcaagtggtacggcaagtacctcaacaaccctttgggacgccccgtgatgttaacggttcagttcacgctcggctggcctttgtacttag

SEQ ID NO: 13065 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctgtgaaacgcaccgtgatgttaacggtacagttcactctcggctggcctttgtacttag

SEQ ID NO: 13066 - DNA, 365 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggcctcatcttccactccttcctcctcgtcccttacttctcctggaagtacaaacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 13067 - DNA, 394 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccgctcgccatgcatgcactgcctccactgcggtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13068 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13069 - DNA, 339 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13070 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 13071 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 13072 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaaatccgacatcaagtggtacggaaagtacctcaacaacccgctagcacgcacggtgatgctaaccgtccagttcacgctcggctggcctttgtacttag

SEQ ID NO: 13073 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgaatgcggccaccacgccttcagcgactaccagtggcttgacgacaccgtcggtctcatcttccactccttcctcctcgtcccttacttctcctggaaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13074 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaatcatcgacgccaccattccaacactggctccctcgagagagacgaagtgtttgtccccaagaagaagtcagacatcaagtggtacggcaagtacctcaacagccctgtgggacgcatcgtgatgttaacggttcagttcactctcggctggcctttgtacttag

SEQ ID NO: 13075 - DNA, 310 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 13076 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtgggcctcgtcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13077 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13078 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccctcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactta

SEQ ID NO: 13079 - DNA, 419 bp, Artificial
  Mutation in BnaA.FAD2.a introduced by TALE nuclease pair BnFAD2_T02
cctctcctccctcaccctctctcctacttcgcctggcctctctactgggcctgccagtgctgcgtcctaaccggcgtctgggtcatagcccacgagtgcggccaccacgccttcagcgactaccagtggctggacgacaccgtcggcctcatcttccactccttcctcctcgtcccttacttctcctggatctccagcggctgttgccggtgctgtgccaggcccacggcttgacccctcagcaggtggtggcagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 13080 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgaccaccagtggctggacgacgccgtgggcctcgtcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13081 - DNA, 357 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccatacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13082 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagtgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13083 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 13084 - DNA, 354 bp, Artificial
  Mutation in BnaA.FAD2.a introduced by TALE nuclease pair BnFAD2_T02
cctctcctccctcaccctctcccttacctcgcctggcccctctcctgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13085 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatgtcatcgacgccaccattccaacactggctccctcgagagagacgaagtgtttgtccccaagaagaagtcagacatcaagtggtacggcaagtacctcaacaaccctgtgggacgcaccgtgaggttaacggttcagtgcactctcggctggccggagtacttag

SEQ ID NO: 13086 - DNA, 416 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggacacaggccaacgtctcaagattgcaaaacgtggcggcgtgaccgcagtggaggtacagtcatcgacgccgccattccaacactggctccctcgagagagacgaagtgtttgtccccaagaagaagtcagacatcaagtggtacggcaagtacctcaacaaccctttgggacgcaccgtgatgttaacgtttcagttcactctcggctggcctttgtacttag

SEQ ID NO: 13087 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcagcagcgctttgggacgcaccgtgatgttaacggttcagttcactctcggctggcctttgtacttag

SEQ ID NO: 13088 - DNA, 319 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgacttcagcgactaccagtggctggacgacaccgtcggcctcatcttccactccttccaccattccaacactggctccctcgagagagacgaagtgtttgtccccaagaagaagtcagacatcaagtggtacggcaagtacctcaacaaccttttgggacgcaccgtgatgttaacggttcagttcactctcggctgacctttgtacttag

SEQ ID NO: 13089 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacgtttcagttcactctcggctggcctttgtacttag

SEQ ID NO: 13090 - DNA, 348 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13091 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtacgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13092 - DNA, 354 bp, Artificial
  Mutation in BnaA.FAD2.a introduced by TALE nuclease pair BnFAD2_T02
cctctcctccctcaccctctcccttacctcgcctggcccctctactggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13093 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13094 - DNA, 366 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacaatcagaaaaggtccactgggttcgtgccttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13095 - DNA, 351 bp, Artificial
  Mutation in BnaA.FAD2.a introduced by TALE nuclease pair BnFAD2_T02
cctctcctccctcaccctctgccttacctcgcctggcccctctcttgggcctgccaaggctgcgccccaacaggcctctgggtcatcgcccacgactgcggccaccacgccttcagcgaccaccagtgcctggacgacgccgtgggcctcgtcttccactccttcctcctcgtcccttacttctccttcatcgacaccaccattccaacactggctccctcgaaagagacgaagtgtttgtccccaagaaaaagtcaaacatcaagtggtaccgcgaatacctcaacaacccgttgggacgcaccgtgagataaacgtttcagatgactctcggctggcctttgtacttag

SEQ ID NO: 13096 - DNA, 348 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacaaagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13097 - DNA, 356 bp, Artificial
  Mutation in BnaA.FAD2.a introduced by TALE nuclease pair BnFAD2_T02
ctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcagcaaccctttgggacgcaccgtgatgttaacggttcagttcactcgcggctggcctttgtacttag

SEQ ID NO: 13098 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcatcgtcccttacttctcctggaagtatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttgtacttag

SEQ ID NO: 13099 - DNA, 310 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13100 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcatggaaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 13101 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagccatcgacgccaccattccaacaccggatccctcgagagggatgaagtgttcgtccccaagaagaaatccgacatcaagtggtacggaaagtacctcaacgccccggtaggacgcgcggtgaggctaaccgggggggtcacgctcggctggccgttgtacgtag

SEQ ID NO: 13102 - DNA, 355 bp, Artificial
  Mutation in BnaA.FAD2.a introduced by TALE nuclease pair BnFAD2_T02
cctctcctccctcaccctctcccctacttcgcctggcctctctactgggcctgccaagggtgcgtcctaaccggcgtctgggtcatcgcccacgaatgcggccaccacgccttcagcgactaccagtggctggacgacaccgtcggcctcatcttccactccttcctcctcgtcccttacttctcctggaagtatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13103 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagtagccatcgacgccaccattccaacactggctccctcgagagagacgaagtgtttgtccccaagaagaagccagccaccaagtggtacggcaagtccctcaacaaccctttgggacgccccgtgatgttaacggttcagtcccctcccggctggccttgtacttag

SEQ ID NO: 13104 - DNA, 354 bp, Artificial
  Mutation in BnaA.FAD2.a introduced by TALE nuclease pair BnFAD2_T02
cctctcctccctcacccctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13105 - DNA, 467 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtggaaagcgggcagtgagcgcaacgcaattaagctcgccgcgttgtttcatcaagccttacggtcaccgtaaccagcaaatcaatatcactgtgtggcttcaggccgccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13106 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccgagggtgcgtcctaaccggcgtctgggtcacagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgccctttgtacttag

SEQ ID NO: 13107 - DNA, 358 bp, Artificial
  Mutation in BnaA.FAD2.a introduced by TALE nuclease pair BnFAD2_T02
cctctcctccctcaccctctctcctacttcgcctggcctctctcctgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtatcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggcatttgtacttag

SEQ ID NO: 13108 - DNA, 356 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 13109 - DNA, 330 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcgccaccattccaacactggctccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 13110 - DNA, 391 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtgtaggtcgttcgctccaagctgggctgtgtgcacgaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13111 - DNA, 360 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggcctcatcttccactccttcctcctcgtcccttacttctcctggaaggcagtcatcgacgccaccattccaacactggctccctcgagagagacgaagtgtttgtccccaagaagaaggcagacatcgagtggtacgggaagtaccgcaggagccgtgtgggacgcgccgtggtgttagcggttcagttcgctctcggctggcctttgtacttag

SEQ ID NO: 13112 - DNA, 358 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13113 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagttggttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13114 - DNA, 387 bp, Artificial
  Mutation in BnaA.FAD2.a introduced by TALE nuclease pair BnFAD2_T02
cctctcctccctcaccctctcccttacctcgcctggcccctctactcggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggcgatggccaccacctgctccggggtcacagtcatcgacgccaccattccaacactggctccctcgagagagacgaagtgtttgtccccaagaagaagtcagacatcaagtgttacggcaagtacctcaacacccctgtgggacgcaccgtgatgttaacggttcagttcactcccggctgccctttgtgcttag

SEQ ID NO: 13115 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccttcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13116 - DNA, 336 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 13117 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13118 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 13119 - DNA, 358 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13120 - DNA, 311 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacaaatgcggccaccacgccttcagcgaccaccagtggctggacgacgccgtgggcctcgtcttccactccttcctcctcgtcccttacttctcctggaatcgtctttgtccccaagaagaagtcagacatcaagtggtacggcaagtacctcaacaaccctttgggacgcaccgtgatgttaacggttcagttcactctcggctggcctttgtacttag

SEQ ID NO: 13121 - DNA, 356 bp, Artificial
  Mutation in BnaA.FAD2.a introduced by TALE nuclease pair BnFAD2_T02
cctctcctccctcccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13122 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccttttggacgcaccgtgatgttaacggttcagttcactctcggctggcctttgtacttag

SEQ ID NO: 13123 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcataaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13124 - DNA, 352 bp, Artificial
  Mutation in BnaA.FAD2.a introduced by TALE nuclease pair BnFAD2_T02
gctcaccaaccgcaccctctctcctacttcgcctggcctctctacagggcctgccagggctgcgtcctaaccggcgtctgggtcatagcccacgagggcggccaccacgccttcagcgactaccagtggctggacgacaccgtcggcctcatcttccactccttcctcctcgtcccttacttctcctggaagcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13125 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggcctcatcttccactccttcctcctcgtcccttacttctcctggaagttggttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13126 - DNA, 408 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtaccggtgctgtgccaggcccacggcttgaccccccagcaggtggtggccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13127 - DNA, 355 bp, Artificial
  Mutation in BnaA.FAD2.a introduced by TALE nuclease pair BnFAD2_T02
cctctcctccctcaccctctcccttacctcgcctggcctctctactgggcctgctaagggtgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13128 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaacccttcgggacgcaccgtgatgttaacggttcagttcactctcggctggcctttgtacttag

SEQ ID NO: 13129 - DNA, 360 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13130 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaattcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13131 - DNA, 356 bp, Artificial
  Mutation in BnaA.FAD2.a introduced by TALE nuclease pair BnFAD2_T02
ctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13132 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaagtcatcgacgccaccattccaacactggctccctcgagagagacgaagtgtttgtccccaagaagaactcagacatcaagtggtacggcaagtacctcaacaaccctttgggacgcaccgtgatgttaacggttcagttcactctcggctggcctttgtacttag

SEQ ID NO: 13133 - DNA, 340 bp, Artificial
  Mutation in BnaA.FAD2.a introduced by TALE nuclease pair BnFAD2_T02
cctctcctccctcaccctctctcctacttcgcctggcctctctcctgagcctgccagggctgcgtcctaaccggcgtctgggtcatagcccacgagtgcggccaccacgccttcagcgactaccagtggcttgacgacaccgtcggtctcatcttccactccttcctcctcgtcccttacttctcccaccattccaacaccggatccctcgatagggacgaagtgttcgtccccaagaagaaatccgacatcaagtggtacggcaagtacctcaacaacccgctaggacgcacggtgatgctaaccgtccagttcacgctcggctggcctttgtacttag

SEQ ID NO: 13134 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgactaccagtggctggacgacaccgtcggcctcatcttccactccttcctcctcgtcccttacttctcctggaatcgacgccaccattccaacactggctccctcgagagagacgaagtgtttttccccaagaagaagtcagacatcaagtggtacggcaagtacctcaacaaccctttgggacgcaccgtgatgttaacggttcagttcactctcggctggcctttgtacttag

SEQ ID NO: 13135 - DNA, 320 bp, Artificial
  Mutation in BnaA.FAD2.a introduced by TALE nuclease pair BnFAD2_T02
ctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggtctcatcttccactccttcctcctcgtcccttacttctcctggaagagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13136 - DNA, 395 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttgaccccccagcaggtggtggccatcgccagccaacagtcatcgacgccaccattccaacactggctccctagagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13137 - DNA, 356 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccagtccaacactggctccctcgagagagacgaagtgtttgtccccaagaagaagtcagacatcaagtggtacggcaagtacctcaacaaccctttgggacgctccgtgatgttaacggttcagttcactctcggctggcctttgtacttag

SEQ ID NO: 13138 - DNA, 448 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccgtggcggcgtgaccgcagtggaggcagtgcatgcatggcgccgatctacgcacgctcggctacagccagcagcaacaggagaagatcaaaccgaaggttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13139 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 13140 - DNA, 408 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccggtgctgtgccaggcccacggcttgaccccccagcaggtggtggccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13141 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13142 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13143 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacgccgtgggcctcgtcttccactccttcctcctcgtcccttacttctcctggaaaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13144 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggcctcatcttccactccttcctcctcgtcccttacttctcctggaactcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13145 - DNA, 362 bp, Artificial
  Mutation in BnaA.FAD2.a introduced by TALE nuclease pair BnFAD2_T02
cctctcctccctcaccctctatcctacttcgcctggcctccctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaacagtcatcgacgccaccattccaacactggctccctcgagagagacgaagtgtttgtccccaagaagaagtcagacatcaagtggtacggcaagtacctcaacaaccctttgggacgcaccgtgatgttaacgtttcagttcactctcggctggcctttgtacttag

SEQ ID NO: 13146 - DNA, 357 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13147 - DNA, 348 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13148 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggtcgacaccgtcggcctcatcttccactccttcctcctcgtcccttacttctcctggaagtcatcgacgccaccattccaaccctgtccccctcgagagagacgaagtgtttgtccccaagcagaagtcagacatcaagtggtacggcaagtaccccatcatccctttgggacgccccttggtgttaacggctcaattcacgctcggctgccctctgtgcctag

SEQ ID NO: 13149 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttatccgtccagttcacgctcggctggccgttgtacttag

SEQ ID NO: 13150 - DNA, 358 bp, Artificial
  Mutation in BnaA.FAD2.a introduced by TALE nuclease pair BnFAD2_T02
cctctcctccctcaccctctcccttacctcgcctggaccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaagagtcatcgacgccaccattccaacactggctccctcgagagagacgaagtgtttgtcccaaagaagaagtcagacatcaagtggtacggcaagtacctcaacaaccctttgggacgcaccgtgatgttaacggttcagttcactctcggctggccgttgtacttag

SEQ ID NO: 13151 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 13152 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcagcaaccctttgggacgcaccgtgatgttaacggttcagttcactctcggctggcctttgtacttag

SEQ ID NO: 13153 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13154 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaaagtcatcgacgccaccattccaacacttgctccctcgagagatacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13155 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgcccggctggcctttgtacttag

SEQ ID NO: 13156 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagcatcgacgccaccattccaacactggctccctcgatagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13157 - DNA, 291 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacaccgtcggaagactggctccctcgagagagacgaactgtttgtccccaagaagaagtcagacatcaagtggtacggcaagtacctcaacaaccctttgggacgcaccgtgatgttaacggttcagttcactctcggctggcctttgtacttag

SEQ ID NO: 13158 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccaagggcgcgtcctaaccggcgtctgggtcatagcccacgagtgcggccaccacgccttcagcgactaccagtggctggacgacaccgtcggcctcatcttccactccttcctcctcgtcccttacttctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttagtacttag

SEQ ID NO: 13159 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacgacaagtacctcaacaaccctttgggacgcaccgtgatgttaacggttcagttcactctcggctggcctttgtacttag

SEQ ID NO: 13160 - DNA, 353 bp, Artificial
  Mutation in BnaA.FAD2.a introduced by TALE nuclease pair BnFAD2_T02
ccttcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtgggcctcgtcttccactccttcctcctcgtcccttacttctcctggaacatcgacgccaccattccaacactggctccctcgagagagacgaagtgtttgtccccaagaagaagacagacatcaagtggtacggcaagtacctcaacaaccctttgggacgcaccgtgatgttaacggttcagttcactctcggctggcctttgtacttag

SEQ ID NO: 13161 - DNA, 360 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagctactaccagtggctggacgacaccgtcggcctcatcttccactccttcctcctcgtcccttacttctcctggaagaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13162 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctccatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13163 - DNA, 336 bp, Artificial
  Mutation in BnaA.FAD2.a introduced by TALE nuclease pair BnFAD2_T02
cctctcctccctcaccctctctcctacttcgcctggcctctctacttggcctgccagggctgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13164 - DNA, 358 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13165 - DNA, 352 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13166 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggcggcgtcctaaccggcgtctgggtcatagcccacgagtgcggccaccacgccttcagcgactaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 13167 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggattcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13168 - DNA, 345 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13169 - DNA, 360 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtaagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 13170 - DNA, 356 bp, Artificial
  Mutation in BnaA.FAD2.a introduced by TALE nuclease pair BnFAD2_T02
ctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13171 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgatagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13172 - DNA, 351 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctccttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13173 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13174 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgcagtgggcctcgtcttccactccttcctcctcgtcccttacttctcctggaagtcatcgatgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 13175 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatcgacgccaccattccaacactggctccctcgagagagacgaagtgtttgtccccaagaagaagtcagacatcaagtggtacggcaagtacctcaacaacccttgggtacgcaccgtgatgttaacggttcagttcactctcggctggcctttgtacttag

SEQ ID NO: 13176 - DNA, 441 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgtgccaggcccacggcttgaccccccagcaggtggtggccatcgccggccagcaacgtcggttcgagatggcgctcgatgacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13177 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctcacgggcctctgggtcatcgcccacgaatgcggccaccacgccttcagcgactaccagtggctggacgacaccgtcggtctcatcttccactccttcctcctcgtcccttacttctcctggaatcatcgacgccaccattccaacactggctccctcgagagagacgaagtgtttgtccccaagaagaagccagacatcaagtggtacggcaagtacctcaacaaccctttgggacgcaccgtgatgttaacggttcagttcactctcggctggcctttgtacttag

SEQ ID NO: 13178 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggacatcgacgccaccattccaacactggctccctcgagagagacgaagtgtttgtccccaagaagaagtcagacatcaagtggtacggcaagtacctcaacaacccgccaggacgcacggtgatgctaaccgtccagttcacgctcggctggcctttgtacttag

SEQ ID NO: 13179 - DNA, 349 bp, Artificial
  Mutation in BnaA.FAD2.a introduced by TALE nuclease pair BnFAD2_T02
cctctcctccctcacctctcccttacctcgcctggcctctctactgggcctgccagggctgcgtcctaaccggcgtctgggtcatagcccacgagtgcggccaccacgccttcagcgactaccagtggcttgacgacaccgtcggtctcatcttccactcctttctcctcgtcccttactcctcctcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 13180 - DNA, 357 bp, Artificial
  Mutation in BnaA.FAD2.a introduced by TALE nuclease pair BnFAD2_T02
cctctccttcctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13181 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttagc

SEQ ID NO: 13182 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcctggcctttgtacttag

SEQ ID NO: 13183 - DNA, 336 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13184 - DNA, 354 bp, Artificial
  Mutation in BnaA.FAD2.a introduced by TALE nuclease pair BnFAD2_T02
ccttcctccctcaccctctctcctacttcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 13185 - DNA, 356 bp, Artificial
  Mutation in BnaA.FAD2.a introduced by TALE nuclease pair BnFAD2_T02
cctctcctccctcaccctctgccttacctcgcctggcccctctcctgagcctgccaaggctgcgtcctaacgggcctctgggtcatcgcccacgaatgcggccaccacgccttcaccgaccaccagtggctggacgacgccgtgggcctcgtcttccactccttcctcctcgtcccttacttctcctggaagtaaggcacgccaccattccaacactggctccctcgagagagacgaagtgtttgtccccaagaagaagtcagacatcaagtggtacggcaagtgcctcaacaaccctttgggacgcaccgtgatgttaacggttcagttcactcgcggctggccttagtacttag

SEQ ID NO: 13186 - DNA, 415 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaagtccgcctttgagtgagctgataccgctcgccgcagccgaacgaccgagcgcagcgagagtcatcgacgccaccattccaacactggctccctcgagagagacgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 13187 - DNA, 356 bp, Artificial
  Mutation in BnaA.FAD2.a introduced by TALE nuclease pair BnFAD2_T02
cctctctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13188 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13189 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccacaagaagaagtcagacatcaagtggtacggcaagtacctcaacaaccctttgggacgcaccgtgatgttaacggttcagttcactctcggctgcctttgtaattag

SEQ ID NO: 13190 - DNA, 360 bp, Artificial
  Mutation in BnaA.FAD2.a introduced by TALE nuclease pair BnFAD2_T02
cctctcctccctcaccctctatcctacttcgcctggcatccctaatgggcctgccagggctgcgtcctaacaggcgtctgggtcatagcccacgagtgcggccaccacgccttcagcgactaccagtggctggacgacaccgtcggcctcatcttccactccttcctcctcgtcccttacttctcctggaagtacgtcatcgacgccaccattccaacactggctccctcgagagagacgaagtgtttgtccccaagaagaagtcagacatcaagtggtacggcaagtacctcaacaaccctttgggacgcaccgtgatgttagcggttcagttcactctcggcgggcctttgtacttag

SEQ ID NO: 13191 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcgtcttccactccttcctcctcgtcccttacttctcctggaaaagtcatcgacgccaccattccaacactggctccctcgagagagacgaagtgtttgtccccaagaagaagtcagacatcaagtggtacggcaagtacctcaacaaccctttgggacgcaccgtgatgttaacggctcagttcactctcggctggcctttgtacttag

SEQ ID NO: 13192 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcgacgccaccattccaacactggctccctcgagagagacgaagtgtttgtccccaagaagaagtcagacatcaagtggtacggcaagtacctcaacaacccgttaggacgcaccgtgatgttaacggttcagttcacgctcggctggcctttgtacttag

SEQ ID NO: 13193 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgtggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttaa

SEQ ID NO: 13194 - DNA, 347 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 13195 - DNA, 349 bp, Artificial
  Mutation in BnaA.FAD2.a introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcccatcgacgccaccattccaacactggctccctcgagagagacgaagtgtttgtccccaagaagaagtcagacatcaagtggtacggcaagtacctcaacacccctttgggacgcaccgtgatgttaacggttcagttcactctcggctggcctttgtacttag

SEQ ID NO: 13196 - DNA, 355 bp, Artificial
  Mutation in BnaA.FAD2.a introduced by TALE nuclease pair BnFAD2_T02
cctctcctccctcaccctctctcctacttcgcctggcctctctcctgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaacatcgacgccaccattccaacactcgctccctcgagagagacgaagtgtttgtccccaagaagaagtcacacatcgagtcgtacggcaagtacctcaacaaccgtttgggacgcaccgtgatgtaaacggttcggttcagtctcggctggcctttgtacctac

SEQ ID NO: 13197 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctccttgtcatctacgccaccattccaacactggctccctcgagagagacgaagtgtttgtccccaagaagaagtcagacatcaagtggtacggcaagtacctcaacatccctttgggacgctccgtgatgttaacggttcagttcacgctcggctggcctttgtacttag

SEQ ID NO: 13198 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13199 - DNA, 352 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctgaagccatcgacgccaccattccaacactggctccctcgagagagacgaagtgtttgtccccaagaagaagtcagacatcaagtggtacgacaagtacctcagcatccctttgggacgcgccgtgatgttaacggttcagttcactctcggctggcctttgtacttag

SEQ ID NO: 13200 - DNA, 458 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagcggtccagcggctgttgcccccatcattgctggcgatggccaccacctgctggggggtcaagccgtgggcctggcacagcaccggcaacagccgctggagagtcatcgacgccaccattccaacactggctccctcgagagagacgaagtgtttgtccccaagaagaagtcagacatcaagtggtacggcaagtacctcaacacccctttgggacgcaccgtgatgttaacggttcagttcactctcggctggcctttgtacttag

SEQ ID NO: 13201 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttg

SEQ ID NO: 13202 - DNA, 405 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtactccagcggctgttgccaccattattgctggcgatggccaccacctgtcatcgacgccaccattccaacactggctccctctagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13203 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13204 - DNA, 363 bp, Artificial
  Mutation in BnaA.FAD2.a introduced by TALE nuclease pair BnFAD2_T02
cctctcctccctcaccctctctcctacttcgcctggcctatctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtacacagtcatcgacgccaccattccaacactggctccttcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13205 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacgacaagtacctcaacaaccctttgggacgcaccgtgatgttaacggttcagttcactctcggctggcctttgtacttag

SEQ ID NO: 13206 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagccacacatcaagtggtacggcaagtacctcagcaaccgtttgggacgcaccgtgaggttaacggttcagttcactctcggctggcctttgtgcttag

SEQ ID NO: 13207 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgactaccagtggctggacgacaccgtcggcctcatcttccactccttcctcctcgtcccttacttctcccatcgacgccaccattccaacactggctccctcgagagagacgaagtgtttgtccccaagaagaagtcagacatcaagtggtacggcaagtacctcaacaaccctttggaacgcaccgtgatgttaacggttcagttcactctcggctggcctttgtacttag

SEQ ID NO: 13208 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13209 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcggttcactctcggctggcctttgtacttag

SEQ ID NO: 13210 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacacagtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13211 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13212 - DNA, 348 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtccctcacttcttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13213 - DNA, 433 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagcggcgagcggtatcagctcactcaaaggcggtaatacggttatccacagaatcaggggataacgcaggaaagaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13214 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13215 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctccacgtcccttacttctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13216 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgccaccgtcggcctcatcttccactccttcctcctcgtcatcgacgccaccattccaaccctggctccctcgagagagacgaagtgtttgtccccaagaagaagtcagacatcaagtggtccggcaagtacctcaacaacccgctaggacgcccggtgatgctaaccgtccaggtcactctcggctggcctttgtacttag

SEQ ID NO: 13217 - DNA, 356 bp, Artificial
  Mutation in BnaA.FAD2.a introduced by TALE nuclease pair BnFAD2_T02
cctctcctccctcaccctctctcctacttcgcctgcactctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaattcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 13218 - DNA, 357 bp, Artificial
  Mutation in BnaA.FAD2.a introduced by TALE nuclease pair BnFAD2_T02
cctctcctccctcaccctctcacttacctcgcctggcacatctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaaagtcatcgacgccaccattccaacactggctccctcgagagagacgaagtgtttgtccccaagaagaagtcagacatcaagtggtacggcaagtgcctcaacaaccctttgggacgcaccgtgatgttaacggttcagttcactctcggctggcctttgtacttag

SEQ ID NO: 13219 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13220 - DNA, 358 bp, Artificial
  Mutation in BnaA.FAD2.a introduced by TALE nuclease pair BnFAD2_T02
cctctcctccctcaccctctatcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13221 - DNA, 418 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaccgaagttatttgccatgtacttggatctagatgtattcgaacgcgagagtagggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13222 - DNA, 401 bp, Artificial
  Mutation in BnaA.FAD2.a introduced by TALE nuclease pair BnFAD2_T02
cctctcctccctcatcctctctcctacttcgcctggcctctctactgggcctgccagggctgcgtcctaaccggcgtctgggtcatagcccacgagtgcggccaccacgccttcagcgaccactagtggctggacgacgccgtgggcctcgtcttccactccttcctcctcgtcccttacttctcctggaagtactgcccgctttccagtcgggaaacctgtcgtgccagctgcaagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacgtag

SEQ ID NO: 13223 - DNA, 406 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtctcatattcactctcaatccaaataatctgcaccggatctcgcccatagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13224 - DNA, 363 bp, Artificial
  Mutation in BnaA.FAD2.a introduced by TALE nuclease pair BnFAD2_T02
cctctcctccctcaccctctatcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13225 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13226 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttggtacgcaccgtgatgttaacggttcagttcactctcggctggcctttgtacttag

SEQ ID NO: 13227 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggatccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 13228 - DNA, 359 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 13229 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagccatcgacgccaccattccaacactggctccctcgagagagacgaagtgtttgtccccaagaagaagtcagacatcaagtggtacggcaagtacctcaacaaccctttgggacgcaccgtgatgttaacggttcatttcactctcggctggcctttgtacttag

SEQ ID NO: 13230 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagacaccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 13231 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggccatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13232 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtgttacggcaagtacctcaacaaccctttgggacgcaccgtgatgttaacggttcagttcactctcggctggcctttgtacttag

SEQ ID NO: 13233 - DNA, 353 bp, Artificial
  Mutation in BnaA.FAD2.a introduced by TALE nuclease pair BnFAD2_T02
cctctcctccctcaccctctcccttacctcgcctggaccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggacatcgacgccaccattccaacactggctccctcgagagagacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 13234 - DNA, 348 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttcttcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 13235 - DNA, 356 bp, Artificial
  Mutation in BnaA.FAD2.a introduced by TALE nuclease pair BnFAD2_T02
cctctcctccctcaccctctaccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagttcctcaacaaccctttgggacgcaccgtgatgttaacggttcagttcactctcggctggcctttgtacttag

SEQ ID NO: 13236 - DNA, 352 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaacacgccttcagcgaccaccagtggctggacgacgccgtcggcctcgtcttccactccttcctcctcgtcccttacttctcctggaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13237 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13238 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctcaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggcacggcaagtaccccaacaagcctgtgggacgcaccgtgatgttaacgcttcagttccctctcggctggcctttgtacttag

SEQ ID NO: 13239 - DNA, 342 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtccctgtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 13240 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgccaccgtcggcctcatcttccactccttcctcctcgtcatcgacgccaccattccaacactggctccctcgagagagacgaagtgtttgtccccaagaagaagtcagacatcaagtgggacgggaagtacctcaacaaccctttgggacgcaccgtgatgttaacggttcaggtcactctcggctggcctttgtacttag

SEQ ID NO: 13241 - DNA, 332 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 13242 - DNA, 357 bp, Artificial
  Mutation in BnaA.FAD2.a introduced by TALE nuclease pair BnFAD2_T02
cctctcctccctcaccctctctcctacttcgcctggcctctctactgtgcctgccagggctgcgtcctaaccggcgtctgggtcatagcccacgagtgcggccaccacgccttcagcgactaccagtggctggacgacaccgtcggtctcatcttccactccttcctcctcgtcccttacaacggcgagctttgatcaacgaccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13243 - DNA, 335 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttactcaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 13244 - DNA, 401 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggcgctggagacggtccagcggctgttgccggtgctgtgccaatagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13245 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactatcggctggcctttgtacttag

SEQ ID NO: 13246 - DNA, 332 bp, Artificial
  Mutation in BnaA.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13247 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcacgtggtacggcaagtacctcaaccaccgtctgggacgcaccgtgaggttaagggtacggttctgtctcggacgcccttagcacttag

SEQ ID NO: 13248 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13249 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctttgggacgcaccgtgatgttaacggttcatttcactctcggctggcctttgtacttag

SEQ ID NO: 13250 - DNA, 344 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13251 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13252 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 13253 - DNA, 372 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttactcaagtcagaggtggcgaaacccgacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13254 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtatcatcgacgccaccattccaacactggctccctcgagagagacgaagtgtttgtccccaagaagaagtcagacatcaagtggtacggcaagtacctcaacaaccctttgggacacaccgtgatgttaacggttcagttcactctcggctggcctttgtacttag

SEQ ID NO: 13255 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13256 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13257 - DNA, 357 bp, Artificial
  Mutation in BnaA.FAD2.a introduced by TALE nuclease pair BnFAD2_T02
cctctcctccctcaccctctcccttacctcgcctggcccctctactgggcccgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13258 - DNA, 431 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaacattgctggcgatggccaccacctgctggggggtcaagccgtgggcctggcacagcaccggcaacagccgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13259 - DNA, 357 bp, Artificial
  Mutation in BnaA.FAD2.a introduced by TALE nuclease pair BnFAD2_T02
cctctcctccctcaccctctctcctacttcgcctggactctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacaacggcgagctttgatcaacgaccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13260 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaacatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgcgcggctggcctttgtacttag

SEQ ID NO: 13261 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13262 - DNA, 405 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaatgttgccaccgccattgctggcgatggccaccacctgctggggggtcaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13263 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttacagtcatcgacgccaccattccaacactggctccctcgagagagacgaagtgtttgtccccaagaagaagtcagacatcaagtggtacggcaagtaccgcaacaaccctttgggacgcaccgtgatgttaacggttcatttcactctcggctgccctttgtacttag

SEQ ID NO: 13264 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13265 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcatcgacgccaccattccaacactggctccctcgagatagacgaagtgtttgtccccaagaagaagtcagacatcaagtggtacggcaagtacctcaacaaccctttgggacgcaccgtgatgttaacgtttcagttcactctcggctggcctttgtacttag

SEQ ID NO: 13266 - DNA, 408 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaatatttggattgagagtgaatatgagactctaattggataccgaggggaatttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13267 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcatggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13268 - DNA, 354 bp, Artificial
  Mutation in BnaA.FAD2.a introduced by TALE nuclease pair BnFAD2_T02
cctctcctccctcaccctctcccttacctcgcctaccccctctactgggcttcccaaggccgcgtcctcacgggcctctgggacatagcccacgagtgtggcctccacgccttcagcgactaccagtggctggacgacaccgtcggcctcatcttccactccttcctcctcgtcccttacttctcctggatcatcgacgccaccattccaacactggctccctcgagagagacgaagtgtttgtccccaagaagaagtcacacatcaagtggcacggcaagtagctgaacacgcctgagggatgcacggtgaagttaacggttcagttcactctcggctggcctttgtacttag

SEQ ID NO: 13269 - DNA, 357 bp, Artificial
  Mutation in BnaA.FAD2.a introduced by TALE nuclease pair BnFAD2_T02
cctctcctccctcaccctctctcctacttcgcctggactctctactgggcctgccagggctgcgtcctaaccggcgtctgggtaatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggttcggcaagtacctcaacaaccctttgggacgcaccgtgatgttaacgcttcagttcactctcggctggcctttgtacttag

SEQ ID NO: 13270 - DNA, 329 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactaccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13271 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctgaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 13272 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtcaccaagaagaagtcagacatcaagtggtacggcaagtacctcaacaaccctttgggacgcaccgtgatgttaacggttcagttcactctcggctggcctttgtacttag

SEQ ID NO: 13273 - DNA, 303 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 13274 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagccatcaagtggtacggcaagtacctcaacaaccctttgggacgcaccgttatgttaacggttcagttcactctcggctggcctttgtacttag

SEQ ID NO: 13275 - DNA, 391 bp, Artificial
  Mutation in BnaA.FAD2.a introduced by TALE nuclease pair BnFAD2_T02
cctcttctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacgcgctaaatgaaaccttaacgctatggaacagtcatcgacgccaccattccaacactggctccctcgagagagacgaagtgtttgtccccaggaagaagtcagacatcaagtggtacggcaagtacctcaacatccctttgggacgcaccgtgatgctaaccgtccggttcacgctcggctggcctttgtacttag

SEQ ID NO: 13276 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 13277 - DNA, 312 bp, Artificial
  Mutation in BnaA.FAD2.a introduced by TALE nuclease pair BnFAD2_T02
cctctcctccctaaccctctctcctacttcgcctggcctctctactgggcctgcgagggctgcgtcctaaccggcgtctgggtcatagcccacgagtgcggccaccacgccttcagcgactaccagtggcttaacgacaccgtcggtctcatcgacgccaccattccaacactggctccctcgagagagacgaagtgtttgtccccaagaagaagtcagacatcaagtggtacagcaagtacctcaacaacccttagggacgcaccgtgatcttaacggttcagttcactctcggctggacttcgtacttag

SEQ ID NO: 13278 - DNA, 291 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 13279 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcatacatcaagtggtacggcaagtacctcaacaaccctttgggacgcaccgtgatgttaacggttcagttcactctcggctggcctttgtacttag

SEQ ID NO: 13280 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctagtcatcgacgccaccattccaacactggctccctcgagagagacgaagtgtttgtccccaagaagaagtcagacatcaagtggtacggcaagtacctcaacacccctttgggacgcaccgtgatgttaacggttcagttcactctcggctggcctttgtccttag

SEQ ID NO: 13281 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtggacctcgtcttccactccttcctcctcgacccttacttctcctacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13282 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagccatcaagtggtacggcaagtacctcaacaaccctttgggacgcaccgtgatgttaacggttcagttcactctcggctggcctttgtacttag

SEQ ID NO: 13283 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctccagtagtcatcgacgccaccattccaacactggctccctcgagagatacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13284 - DNA, 346 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgaccaccagtggcttgacgacaccgtcggtctcatcttccactccttcctcctcgtcccttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13285 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13286 - DNA, 348 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttcttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13287 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13288 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 13289 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcgtctgggtcatcgcccacgaatgcggccaccacgccttcagcgaccaccagtggctggacgacgccgtgggcctcgtcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13290 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 13291 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagctaccaccagtggcttgacgacaccgtcggcctcatcttccactccttcctcctcgtcccttacttctcctggaagtcatcgacgccaccattccaacaccggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13292 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13293 - DNA, 321 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13294 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgctccgtgatgttaacggttcagttcactctcggctggcctttgtacttag

SEQ ID NO: 13295 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccttggggacgcactgtgatgtgaacggttcagttcaccctcggctggcctttgtacttag

SEQ ID NO: 13296 - DNA, 345 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttcttcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13297 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcacttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactttcggctggcctttgtacttag

SEQ ID NO: 13298 - DNA, 335 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttactcaccattccaacactggctccctcgagagagacgaagtgtttgtccccaagaagaagtcagacatcaagtggtacggcaagtacctcaacaaccctttgggacgcaccgtgatgttaacggttcaattcactctcggctggcctttgtacttag

SEQ ID NO: 13299 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13300 - DNA, 469 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagctactaccagtggcttgacgacaccgtcggtctcatcttccactccttcctcctcgtcccttacttctcctggaagtgcgccgttaccaccgctgcgttcggtcaaggttctggaccagttgcgtgagcgcatacgctacttgcatacttgacagcgacggtccctaacgctgccgggtgttggcttagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13301 - DNA, 345 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcttcccttacttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13302 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttaa

SEQ ID NO: 13303 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacggacctctgggtcatcgcccacgaatgcggccaccacgccttcagcgaccaccagtggctggacgacgccgtgggcctcgtcttccactccttcctcctcgtcccttacttctcctggccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13304 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13305 - DNA, 357 bp, Artificial
  Mutation in BnaA.FAD2.a introduced by TALE nuclease pair BnFAD2_T02
cctctcctccctcaccctctcccttacctctcctggcctctctactgggcctgccagggctgcgtcctaaccagcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagccatcaagtggtacggcaagtccctcaacacccctttgggacgcaccgtgcagttaacggctcagttcactctcggctggcctttgtacttag

SEQ ID NO: 13306 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcgagtggtacggcaagtacctcaacaaccctttgggacgcaccgtgatgttaacggttcagttcactctcggctggcctttgtacttag

SEQ ID NO: 13307 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcctcttccactccttcctcctcgtccctttcttctcctggaacctcatcgacgccaccattccaacactggctccctcgagagagacgaagtgtttgtccccaagaccaagtcagacatcacgtggtacggcgagtgccccaacaacccgctaggccgcacggtgatgctaagcccccagttcacgctcggctggcctttgtacttag

SEQ ID NO: 13308 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtaccccaacaaccctgtgggacgcaccgtgatgttaacggttcagttcactctcggctggcctttgtacttag

SEQ ID NO: 13309 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttaattctcctggacatcgacgccaccattccaacaccggatccctcgagagggatgaagtgttcgtccccaagaagaaatccgacatcaagtggtacgacaagttcctcaacaaccgatggggacgcaccgtgatgttaacggttcagttcactctcggctggcctttgtacttag

SEQ ID NO: 13310 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcccggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13311 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtccattacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13312 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13313 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaccatgacgccaccattccaacaccggatccctcgatagggacgaagtgttcgtccccaagaagaagtcagacatcaagtggtacggcaagtacctcaacaaccctttgggacgcaccgtgatgttaacgggtcagttcactctcggctggcctttgtacttag

SEQ ID NO: 13314 - DNA, 397 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccagcggtggtttgtttgccggaaaaagagttggtacagtcatcgacgccaccattcaaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13315 - DNA, 357 bp, Artificial
  Mutation in BnaA.FAD2.a introduced by TALE nuclease pair BnFAD2_T02
cctctcctccatcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 13316 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcctcttccactccttcctcctcgtcccttacttctcctggaaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13317 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtttcatcgacgccaccattccaacactggctccctcgagagagacgaagtgtttgtccccaagaaaaagtcagacatccagtcgtacggcgagtacctcaacaaccctttgggacgcaccatgatgttaacggttcggttcgctctcggctggcctttgtacttag

SEQ ID NO: 13318 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgttcccaagaagaagtcagacatcaagtggtacggcaagtacctcaacaagcctttgggacgcaccgtgatgttaacggttcagttcactctcggctggcctttgtacttcg

SEQ ID NO: 13319 - DNA, 422 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacggcttgaccccggagcaggtggtggccatcgccagccacgatggcggcaagcaggcgctggagtcatcaacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13320 - DNA, 357 bp, Artificial
  Mutation in BnaA.FAD2.a introduced by TALE nuclease pair BnFAD2_T02
cctctcctccctcaccctctcccttacctcgcctgccccctcttctgtgccttccacgtctgcgtcctcacgggcgtctgggtcatagcccacgcgtgcggccaccacgccttccgcgactaccagtggctggacgacaccgtcggcctcctcttccactccttcctcctcgtcccttacttctcctggaaagtcatcgacgccaccattccaacactggctccctcgagagagacgaagtgtttgtccccaagaagaagtcagacatcaagaggtacggcaaggacctcaacaaccctttgggacgcaccgtgatgttaacggttcagttcactctcgggtggcattagtacttag

SEQ ID NO: 13321 - DNA, 354 bp, Artificial
  Mutation in BnaA.FAD2.a introduced by TALE nuclease pair BnFAD2_T02
cctctccccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccgttagggacgcaccgtgaggttaacggttcagttcactctcggctggcctttgtacttag

SEQ ID NO: 13322 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcatttgtacttag

SEQ ID NO: 13323 - DNA, 312 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcgacgccaccattccaacactggctccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13324 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13325 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 13326 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 13327 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcctcttccactccttcctcctcgtcccttacttctcctggaaagtcatcgacgccaccattccaacactggctccctcgagagagacgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 13328 - DNA, 378 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatatggcggcaagcaggcgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13329 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagtcatcgacgccaccattccaacactggctccctcgagagagacgaagtttttgtccccaagaagaagtcagacatcaagtggtacggcaagtacctcaacaaccctttgggacgcaccgtgatgttaacggttcagttcacgctcggctggcctttgtacttag

SEQ ID NO: 13330 - DNA, 348 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgactccgtcggcctcatcttccactccttcctcctcgtcccttacttcttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13331 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 13332 - DNA, 428 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtggcgatggccaccacctgctccggggtcaagccgtgggcctggcacagcaccggcaacagccgctgggcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13333 - DNA, 407 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacggtgctgttccgcgcgatctcgatcagctcgatgtactcgtgggacagtcatcgacgccaccattccaacaccggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13334 - DNA, 321 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggaagagagagacgaagtgtttgtccccaagaagaagtcagacatcaagtggtacggcaagtacctcaacaaccctttgggacgcaccgtggtgttaaccgttcagttcactctcggctggcctttgtacttag

SEQ ID NO: 13335 - DNA, 341 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaaattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13336 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcggttcactctcggctggcctttgtacttag

SEQ ID NO: 13337 - DNA, 416 bp, Artificial
  Mutation in BnaA.FAD2.a introduced by TALE nuclease pair BnFAD2_T02
cctctcctccctcaccctctctcctacttcgcctggcctctctcctgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggacacaggccaacttctcaagattgcaaaacgtggcggcgtgaccgcagtggaggtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13338 - DNA, 353 bp, Artificial
  Mutation in BnaA.FAD2.a introduced by TALE nuclease pair BnFAD2_T02
gctctccgcccgcaccctctctcctacttcgcctggcctctctaaagggcaggccagggctgcgtcctaaccggcgtctgggtcatagcccacgagtgaggccaccacgccttcagcgactaccagtggctggacgacaccgtcggtctcatcttccactccttcctcctcgtcccttacttctccttgtcatcgacgccaccattccaacactggctccctcgagagagacgaagtgtttgtccccaagaagaagtcagacatcaagtggtacggcaagtacctcaacacccctttgggacgcaccgtgatgttcacggttcagttcactctcggctggcctttgtacttag

SEQ ID NO: 13339 - DNA, 346 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccgtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13340 - DNA, 355 bp, Artificial
  Mutation in BnaA.FAD2.a introduced by TALE nuclease pair BnFAD2_T02
cctctcctccctcaccgtctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13341 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 13342 - DNA, 392 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagactgagcctttcgttttatctgttgtttgtcggtgaacgctcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13343 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 13344 - DNA, 336 bp, Artificial
  Mutation in BnaA.FAD2.a introduced by TALE nuclease pair BnFAD2_T02
cctctcctccatcaccctctctcctacttcgcctggcctctctactgggcctgccagggctgcgtcctaaccggcgtctgggtcatagcccacgagtgcggccaccacgccttcagcgaccaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13345 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcgtcttccactccttcctcctcgtcccttacttctcctggaagtagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13346 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtacaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13347 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaacagtggctggacgacaccgtcggcctcatcttccactccttcctcctcgtcccttacttctcctggaaatcatcgacgccaccattccaacactggctccctcgagagagacgaagtgtttgtccccaagaagaaatccgacatcaagtggtacggaaagtacctcaacaacccgctaggacgcacggtgatgctaacggttcagttcacgctcggctggcctttgtacttag

SEQ ID NO: 13348 - DNA, 323 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggccccatcttccactccttcctcctcgtcccttacttctcctggaagtaccgctcgccgcagccgaacgaccgagaagaagtcagacatcaagtggtacggcaagtacctcaacaaccctttgggacgcaccgtgatgttaacggttcagttcactctcggctggcctttgtacttag

SEQ ID NO: 13349 - DNA, 345 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttcttcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13350 - DNA, 356 bp, Artificial
  Mutation in BnaA.FAD2.a introduced by TALE nuclease pair BnFAD2_T02
cctctcctccctcaccctctctcctacttcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcatttgtacgtag

SEQ ID NO: 13351 - DNA, 352 bp, Artificial
  Mutation in BnaA.FAD2.a introduced by TALE nuclease pair BnFAD2_T02
cctctcctccctcaccctctcccttacctcgccttgcccctctactgggcctgccagggctgcgtcctaaccggcgtctgggtcatcgcccacgagtgcggccaccacgccttcagcgactaccagtggctggacgacaccgtcggcctcatcttccactccttcctcctcgtcccttacttctcctggaatcgacgccaccattccaacaccggatccctcgagagagacgaagtgtttgtccccaagaagaagtcagacatcaagtggtacggcaagtacctcaacaaccctgtgggacgcaccgggatgttaacagttcagttcactcccggcgggccttggtccttag

SEQ ID NO: 13352 - DNA, 332 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagctcacgagtgcggccaccacgccttcagcgactaccagtggctggacgacaccgtcggcctcatcttccactccttcctcctcgtcccttacttctcctggaactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13353 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgttcgtccccaagaagaaatccgacatcaagtgttacggaaagtacctcaacaacccgctaggacgcacggtgatgctaagcgtctagttcacgctcggctggcctttgtacttag

SEQ ID NO: 13354 - DNA, 355 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcgtcttccactccttcctcctcgtcccttacttctcctggaatcatcgacgccaccattccaacactggctccctcgagagagacgaagtgtttgtccacaagaagaagtcagacatcaagtggtacggcaagtacctcaacaaccctttgggacgcaccgtgatgttaacggttcagttcactctcggctggcctttgtacttag

SEQ ID NO: 13355 - DNA, 358 bp, Artificial
  Mutation in BnaA.FAD2.a introduced by TALE nuclease pair BnFAD2_T02
cctctcctccctcaccctctctcctacttcgcctggtctctctcctgggcctgccagggctgcgtcctaaccggcgtctgggtcatagcccacgagtgcggccaccacgccctcagccactaccagtggctggacgacgccgtcggcctcatcttccactccttcctcctcgtcccttacttctcctggaagagtcatcgacgccaccattccaacactggctccctcgagagagacgaagtgtttgtccccaagaagaagtcagacatcgagtggtacggcaagtacctcaacaaccctttggaacgcaccgtgatgttaacggtgcagttcactctcggctggcctttgtacttag

SEQ ID NO: 13356 - DNA, 336 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13357 - DNA, 324 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccatcgacgccaccattccaacactggctccctcgagagagacgaagtgtttgtccccaagaagaagtcagacatcaagtggtacggcaagtacctcaacaaccctctgggacgcaccgtgatgttaacggttcagttcactctcggctggcctttgtacttag

SEQ ID NO: 13358 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagtatcgacgccaccattccaacactggttccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 13359 - DNA, 349 bp, Artificial
  Mutation in BnaA.FAD2.a introduced by TALE nuclease pair BnFAD2_T02
cctctcctccctccccctctctcctacttcgcctggcctctctactgggcctgccagggctgcgtcctaaccggcgtctgggtcatagcccacgcgtgcggccaccacgccttcagcgactaccagtggctggacgacaccgtcggcctcatcttccactccttcctcctcgtcccttacttccgtcatcgacgccaccattccaacactggctccctcgagagagacgaagtgttcgtccccaagaagaaatccgacatcaagtggtacggaaagtacctcaacaacccgctaggacgcgcggtgatgctaaccgcgcaggtcacgctcggctggccgtagtacgtag

SEQ ID NO: 13360 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13361 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggacagtcatcgacgccaccattccaacactggctccctcgagagagacgaagtgtttgtccccaagaagaagtcagacatcaagtggtacggcaagtacctcaacaaccctttgggacgcactgtgatgttaacggttcagttcactctcggctggcctttgtacgtag

SEQ ID NO: 13362 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13363 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13364 - DNA, 350 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttactcctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13365 - DNA, 357 bp, Artificial
  Mutation in BnaA.FAD2.a introduced by TALE nuclease pair BnFAD2_T02
cctcccctccctcaccctctcccttacctcgcctggcccctctactgggcctgccaaggctgcgtcctaacgggcctctgggtcatcgcccacgaatgcggccaccacgccttcagcgactaccagtggcttgacgacaccgtgggcctcgtcttccactccttcctcctcgtcccttacttctcctggaaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13366 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgaatgcggccaccacgccttcagcgaccaccagtggctggacgacgccgtgggcctcgtcttccactccttcctcctcgtcccttacttctcctggaagtacgtcatcgacgccaccattccaacactggctccctcgagagagacgaagtgtctgtccccaagaagaagtcagacctcacgtggtacggcaagtacctcaacatgcgttcgggacgccgtgtggtgttaagggctcagttcactctcggctggcctttgtgcctag

SEQ ID NO: 13367 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13368 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13369 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaggaagtcagacatcaagtggtacggcaagtacctcaacaaccctttgggacgcaccgtgatgttaacggttcagttcactctcggctggcctttgtacttag

SEQ ID NO: 13370 - DNA, 358 bp, Artificial
  Mutation in BnaA.FAD2.a introduced by TALE nuclease pair BnFAD2_T02
cctctcctccctcaccctctctcctacttcgtctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccgccattccaacaccggatcccgcgagagaggcggagtgtttgtccccaagaagaaatcagacatcgggtgggacggcaagtacctcaacagccctttggaacgcaccgtgatgttaacggttcagttcactctcggtctagcctttgtgcttag

SEQ ID NO: 13371 - DNA, 391 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtgtaggtcgttcgctccaagctgggctgtgtgcacgaatcgacgccaccattccaacactggctccctcgagagagacgaagtgtttgtccccaagaagaagtcagacatcaagtggtacggaaagtacctcaacaacccgctaggacgcacggtgatgctaaccggccagtgcacgctcggctggcctttgtacttag

SEQ ID NO: 13372 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13373 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 13374 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13375 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 13376 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggatcgacgccaccattccaacactggctccctcgagagagacgaagtgtttgtccccaagaagaaaccccacatcacgtcgtacggaaagtacctcaacaacccgctaggccgcccggtgaggctaatcgtacgggtcacgcccggctggcctttgtgcctag

SEQ ID NO: 13377 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13378 - DNA, 356 bp, Artificial
  Mutation in BnaA.FAD2.a introduced by TALE nuclease pair BnFAD2_T02
cctctcctccctcaccctctctcctacttcgcctggcctctccactgggcctgccagggctgcgccctaaccggcgtctgggtcatagcccacgagtgcggccaccacgccttcagcgactaccagtggctggacgacaccgtcggcctcctcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccgtttgggacgcaccgtgatgttaacggttcagttcactctcggctggcctttgtacttag

SEQ ID NO: 13379 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 13380 - DNA, 387 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtccctttgcctggcacagcaccggcaacagccgctggaccgtctccagctgtcatcgacgcaaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 13381 - DNA, 401 bp, Artificial
  Mutation in BnaA.FAD2.a introduced by TALE nuclease pair BnFAD2_T02
cctctcctccctaaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggcgctggagacggtccagcggctgttgccggtgctgtgccaatagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13382 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcctcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgctaaccgtccagttcacgctcggctggcctttgtacttag

SEQ ID NO: 13383 - DNA, 345 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtacattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13384 - DNA, 291 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccattccaacactggctccctcgagatagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13385 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccatgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 13386 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 13387 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13388 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgcgtcatagcccacgagtgcggccaccacgccttcagcgactaccagtggctggacgacaccgtcggcctcatcttccactcctttctcctcgtcccttacttctcctggaagcagccatcgacgccaccattccaacaccggatccctcgagagggatgaagtgttcgtcccctataagatacccgacatcaagtggtacgggaagtacctcaacaacccgctaggacgcagggtgaggctaaccgtacaggtgacgcccggctggcttttgtgcttag

SEQ ID NO: 13389 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgtgggacgcgccgtgatgttaacggatcagttcactctcggctggcctttgtacttaa

SEQ ID NO: 13390 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaacccgctaggacgcaccgtgatgttaacggttcagttcactctcggctggcctttgtacttag

SEQ ID NO: 13391 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcttgcctttgtacttag

SEQ ID NO: 13392 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13393 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagccaacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13394 - DNA, 384 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctgcaatggcgatggcaagcaggcgctggagacggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13395 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13396 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13397 - DNA, 358 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggttatagcccacgagtgcggccaccacgccttcagcgactaccagtggctggacgacaccgtcggcctcatcttccactccttcctcctcgtcccttacttctcctggaagagtcatcgacgccaccattccaacactgggtccctcgagagagacgaagtgtttgtccccaagaagaagtcagacatcgagtggtacggcgagtacctcaacaccccgttgggacgcaccgtgatgttaacggttcagttcactctcggctggcctttgtacttag

SEQ ID NO: 13398 - DNA, 322 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13399 - DNA, 359 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13400 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 13401 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagggatgaagtgttcgtccccaagaagaaatccgacatcaagtggtacggaaagtacctcaacaagcggctaggacgcaccgtgatgttaaccgttccgttcactctcggctggcctttgtacttag

SEQ ID NO: 13402 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13403 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13404 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctgtacgacaccgtcggcctcatcttccactccttcctcctcgtcccttacttctcctggaatcgacgccaccattccaacacttgctccctcgagagatacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 13405 - DNA, 394 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtgagtcacgttatgacccccgccgattacgcgggacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13406 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13407 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttctcctggaagagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 13408 - DNA, 419 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacattccgtggcgttatccagctaagcgcgaactgcaatttggagaatggcagcgcaatgacacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13409 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13410 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgttggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13411 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccactccaacactggctccctcgagagagacgaagtgtttgtccccaagaagaagtcagacatcaagtggtacggcaagtacctcaacaaccctttgggacgcaccgtgatgttaacggttcagttcactctcggctggcctttgcacttag

SEQ ID NO: 13412 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13413 - DNA, 350 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcctcgcccacgaatgcggccaccacgccttcagcgaccaccagtggctggacgacgccgtgggcctcgtcttccactccttcctcctcgtcccttactaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13414 - DNA, 372 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttactcaagtcagaggtggcgaaacccgacagtcatcgacgccaccattccaacactggctccctcgagagagacgaagtgtttgtccccaagaagaagtcagacatcaagtggtacggcaagtaccgcaacaacccttagggacgcaccgtgatgttaacggtgcagttcactctcggctggcctttgtacttag

SEQ ID NO: 13415 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaaaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13416 - DNA, 355 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13417 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggaagcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13418 - DNA, 306 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13419 - DNA, 352 bp, Artificial
  Mutation in BnaA.FAD2.a introduced by TALE nuclease pair BnFAD2_T02
cctcacctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13420 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggatccctcgagagggatgaagtgttcgtccccaagaagaaatccgacatcaagtggtacggcaagtacctcaacaaccctttgggacgcaccgtgatgttaacggtgcagttcactctcggctggcctttgtacttag

SEQ ID NO: 13421 - DNA, 379 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggtcgttcggctgcggcgagcggtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13422 - DNA, 445 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtgtgcacgaaccccccgttcagcccgaccgctgcgccttataggggataacgcaggaaagaacatgtgagcaaaaggccagcaaacgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13423 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13424 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttgccatcgacgccaccattccaacactggctccctcgagagagacgaagtgtttgtccccaagaagaagtcagccatcaagtggtacggcaagtacctcaacaaccctttgggacgcaccgtgatgttaacggttcagttcactctcggctggcctttgtacttag

SEQ ID NO: 13425 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcatttgtacttag

SEQ ID NO: 13426 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttgtacttag

SEQ ID NO: 13427 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgataccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13428 - DNA, 318 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccttgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13429 - DNA, 419 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacattccgtggcgttatccagctaagcgcgaactgcaatttggagaatggcagcgcaatgacacatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 13430 - DNA, 364 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtgggcctcgtcttccactccttcctcctcgtcccttacttctcctggaagtattacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 13431 - DNA, 341 bp, Artificial
  Mutation in BnaA.FAD2.a introduced by TALE nuclease pair BnFAD2_T02
cctctcctccctcaccctctcccttacctcgcctgtcccctctactgggcctgccaaggctgcgtcctaacgggcctctgggtcatagcccacgagtgcgaccaccacgccttcagcgactaccagtggctggacgacaccgtcggcctcatcttccactccttcctcctcgtccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13432 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13433 - DNA, 358 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagtgactaccagtggctggacgacgccgtgggcctcgtcttccactccttcctcctcgtcccttacttctcctggaacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13434 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13435 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggcgccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13436 - DNA, 431 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgaccaccagtggctggacgacgccgtgggcctcatcttccactccttcctcctcgtcccttacttctcctggaacattgctggcgatggccaccacctgctggggggtcaagccgtgggcctggcacagcaccggcaacagccgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13437 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacactggctccctcgagagagacgaagtgtttgtcaccaagaagaagtcagacatcaagtggtacggcaagtacctcaacaaccctttgggacgcaccgtgatgttaacggttcagttcactctcggctggcctttgtacttag

SEQ ID NO: 13438 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagtcatcgacgccaccattccaacactggctccctcgagagagacgaagtgtttgtccccaagaagaagtcagacatcaagtggtacggcaagtacctcaacacccttttgggacgcaccgtgatgttaacggttcagttcactctcggctggcctttgtacttag

SEQ ID NO: 13439 - DNA, 332 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaactggctccctcgagagagacgaagtgtttgtccccaagaagaagtcagacatcaagtggtacggcaagtacctcaacaaccctttgggacgcaccgtgatgttaacggttcagttcactctaggctggcctttgtacttag

SEQ ID NO: 13440 - DNA, 344 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacgccgtcggcctcatcttccactccttcctcctcgtcccttcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13441 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13442 - DNA, 354 bp, Artificial
  Mutation in BnaA.FAD2.a introduced by TALE nuclease pair BnFAD2_T02
cctctctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagcatcgacgccaccattccaacactggctccctcgagagagacgaagtgtttgtccccaagaagaagtcacacatcaagtggtacggcaagtacctcaacatccctttgggacgcaccgtgatgttaacggttcggttcacgctcggctggcctttgtacttag

SEQ ID NO: 13443 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacgtag

SEQ ID NO: 13444 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctcgacgacaccgtcggcctcatcttccactccttcctcctcgtcccttacttctcctggaaatcgacgccaccattccaacactggctccctcgagagagacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 13445 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaccatgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13446 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13447 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13448 - DNA, 291 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13449 - DNA, 391 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctagaagtgtaggtcgttcgctccaagctgggctgtgtgcacgaatcgacgccaccattccgacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13450 - DNA, 391 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtaggtcgttcgctccaagctgggctgtgggcacgaatcgacgccaccattccaacactggctccctcgagagagacgaagtgttggtccccaagaagaagtcagacatcaagtggtacggcaagtacctcaacaaccctttgggacgcaccgtgatgttaacggttcagttcactctcggctggcctttgtacttag

SEQ ID NO: 13451 - DNA, 416 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcaacttgaccccggagcaggtggtggcccacggcttgaccccccagcaggtggtggcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13452 - DNA, 348 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttcttcatcgacgccaccattccaacactggctccctcgagagagacgaagtgtttgtccccaagaagaagtcagacatcaagtggtacggaaagtacctcaacaaccctttgggacgcaccgtgatgttaacggttcagttcactctcggctggcctttgtacttag

SEQ ID NO: 13453 - DNA, 364 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtattacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13454 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13455 - DNA, 353 bp, Artificial
  Mutation in BnaA.FAD2.a introduced by TALE nuclease pair BnFAD2_T02
ctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13456 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctcacgggcctctgggtcatcgcccacgaatgcggccaccacgccttcagcgaccaccagtggctggacgacgccgtgggcctcgtcttccactccttcctcctcgtcccttacttctcctggaaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13457 - DNA, 427 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtacaaggcggtaatacggttatccacagaatcaggggataacgatatcgatgctgtccatgtgctgtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13458 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 13459 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcacgtggtacggcaagtacctcaacaacccgttgggacgcaccgtgatgttaacggtgcagttcactctcggctggcatttgtacttag

SEQ ID NO: 13460 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtatcatcgacgccaccattccaacactggctccctcgagagagacgaagtgtttgtccccaagaagaagtcagacatcaagtggtacggcaagtacctcaacaaccctttgggacgcaccgtgatgttaacgggtcagttcactctcggctggcctttgtacttag

SEQ ID NO: 13461 - DNA, 408 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaccgtcgctgtcaagtatcaggacatgatcgcagcgttgccagaggcgacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13462 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcaccgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13463 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13464 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcctctgggtcatcgcccacgaatgcggccaccacgccttcagcgaccaccagtggctggacgacaccgtcggcctcatcttccactccttcctcctcgtcccttacttctcctggaatcatcgacgccaccattccaacactggctccctcgagagatacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13465 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13466 - DNA, 358 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13467 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13468 - DNA, 407 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacggtgctgttccgggcgatctcgatcagctcgatgtactcgtgggacagtcatcgacgccaccagtccaacactggctccctcgagagagacgaagtgtttgtccccaagaagaagtcagacatcaagtggtacggcaagtacctcaacaacccttggggacgcaccgtgatgttaacggttcagttcacgctcggctggcctttgtacttag

SEQ ID NO: 13469 - DNA, 397 bp, Artificial
  Mutation in BnaA.FAD2.a introduced by TALE nuclease pair BnFAD2_T02
cctctcctccctcaccctctctcctacttcgcctggcctctctactgggcctgccaggactgcgtcctaaccggcgtctgggtcatagcccacgagtgcggccaccacgccttcagcgactaccagtggctggacgacaccgtcggcctcatcttccactccttcctcctcgtcccttacttctcctggaaatgcccgaggcatagactgtaccccaaaaaaacagtcataagtcatcgacgccaccattccaacactggctccctcgagagagacgaagtgtttgtccccaagaagaagtcagccatcaagtggtacggcaagtacctcaacaaccctttgggacgcaccgtgatgttaacggttcagttcactctcggctggcctttgtacttag

SEQ ID NO: 13470 - DNA, 345 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttcttcgacgccaccattccaacactggctccctcgagagagacgaagtgtttgtccccaagaagaagtcagacatcaagtggtacggcaagtacctcaacaaccctttgggacgcaccgtgatgttaacggttaagttcactctcggctggcctttgtacttag

SEQ ID NO: 13471 - DNA, 417 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggatttgtcctactcaggagagcgttcaccgacaaacaacagataaaacgaaaggccgtcagtcatcgacgccaccattccaacactggctccctcgagagagacgaagtgtttgtccccaagaagaagtcagacatcgagtggtacggcaagtacctcaacacccctttgggacgcaccgtgatgttaacggttcagttcactctcggctggcctttgtacttag

SEQ ID NO: 13472 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttccgttcactctcggctggcctttgtacttag

SEQ ID NO: 13473 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacgggtcagttcactctcggctggcctttgtacttag

SEQ ID NO: 13474 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 13475 - DNA, 352 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 13476 - DNA, 346 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13477 - DNA, 390 bp, Artificial
  Mutation in BnaA.FAD2.a introduced by TALE nuclease pair BnFAD2_T02
ctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgggcctggcacagcaccggcaacagccgctggagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 13478 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctgtgggacgcgccgtgatgttaacggttcagttcactctcggcgggccgttgtacttag

SEQ ID NO: 13479 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcactgtgatgttaacggttcagttcactctcggctggcctttgtacttag

SEQ ID NO: 13480 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctagacgacaccgtcggcctcatcttccactccttcctcctcgtcccttacttctcctggaatcatcgacgccaccattccaacactggctccctcgagagagacgaagtgtttgtccccaagaagaagtcagacatcaagtggtccggcaagtccctcaacaaccctgtgggacgcaccgtgatgttaaccgttcagttcactctcggctggcctttgtacttag

SEQ ID NO: 13481 - DNA, 357 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13482 - DNA, 324 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 13483 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtaccttaattctcctggacatcgacgccaccattccaacactggctccctcgagagagacgaagtgtttgtccccaagaagaagtcagacatcgagtggtacggcaagtacctcaacaaccctttgggacgcaccgtgatgttaacggtgcagttcactctcggctggcctttgtacttag

SEQ ID NO: 13484 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatctacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13485 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaataagaagtcagacatcaagtggtacggcaagtacctcaacaaccctttgggacgcaccgtgatgttaacggtgcagttcactctcggctggcctttgtacttag

SEQ ID NO: 13486 - DNA, 404 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtatctccagcgcctgcttgccaccgccattgctggcgatggccaccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13487 - DNA, 428 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtggcgatggccaccacctgctggggggtcaagccgtgggcctggcacagcaccggcaacagccgctgggcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13488 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 13489 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgctgttaacggttcagttcactctcggctggcctttgtacttag

SEQ ID NO: 13490 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctggggcatagcccacgagggcggccaccacgccttcagcgactaccagtggcttgacgacaccgtcggtctcatcttccactccttcctcctcgtcccttacttctcctggaaagtcatcgacgccaccattccaacaccggatccctcgagagtgatgaagtgttcgtccccaagaagaaatccgacatcaagtggtacggaaagtccctcaacaaccctttgggacgcaccgtgatgctcacgggtcagttcactctcggctggcctttgtacttag

SEQ ID NO: 13491 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13492 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaaatccgacatcaagtggtacggaaagtaccgcaacaacccgctaggacgcacggtgatgctaaccgtccagttcacgctcggctggcctttgtacttag

SEQ ID NO: 13493 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccactattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13494 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagaccacgagtgcggccaccacgccttcagcgactaccagtggctggacgacaccgtcggcctcatcttccactccttcctcctcgtcccttacttctcctggaagtcgacgccaccattccaacactggctccctcgagagagacgaagtgtttgtccccaagaagaagtcagacatcaagtggtacggcaagtacctcaacaaccctttgggacgctccgtgatgttaacggttcagttcactctcggctggcctttgtacttag

SEQ ID NO: 13495 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcgtcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13496 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13497 - DNA, 323 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtactgctcgccgcagccgaacgaccgagaagaagtcagacatcaagtggtacggcaagtacctcaacaaccctttgggacgcaccgtgatgttaacggttcagttcactctcggctggcctttgtacttag

SEQ ID NO: 13498 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacagccctttgggacgcaccgtgatgttaagagttcagttcactctcggctggcctttgtacttag

SEQ ID NO: 13499 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaaaccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 13500 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgtggccaccacgccttcagcgactaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13501 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctaggtcatagcccacgagtgcggccaccacgcattcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13502 - DNA, 441 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagctcggtttgatcgacagtggcgcagcaccacgaggcactggtcggccacgggtttacacacgcgcacatcgttgcgttaagccagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 13503 - DNA, 388 bp, Artificial
  Mutation in BnaA.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaggcctttttacggttcctggccttttgcgtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13504 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtaaggcacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 13505 - DNA, 303 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgtggccaccacgccttcagcgactaccagtggcttgacgacaccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13506 - DNA, 357 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13507 - DNA, 348 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttcttcatcgacgccaccattccaacactggctccctcgagagagacgaagtgtttgtccccaagaagaaatccgacatcaagtggtacggaaagtacctcaacaaccctttgggacgcaccgtgatgttaacggttcagttcactctcggctggcctttgtacttag

SEQ ID NO: 13508 - DNA, 412 bp, Artificial
  Mutation in BnaA.FAD2.a introduced by TALE nuclease pair BnFAD2_T02
cctctcctccctcaccctctcccttacctcgcctggcccctctactgggcctgcaaaggctgcgtcctaacaggcctctgggtcatcgcccacgaatgcggccaccacgccttcagcgaccaccagtggctggacgacgccgtgggcctcgtcttccactccttcctcctcgtcccttacttctcctattattattccaccaggtggtggccatcgccagcaataatggtggcaagcaggcgctggagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 13509 - DNA, 336 bp, Artificial
  Mutation in BnaA.FAD2.a introduced by TALE nuclease pair BnFAD2_T02
cctctcctccctcacccactctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13510 - DNA, 306 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcatcgacgccaccattccaacactgactccctcgagagagacgaagtgtttgtccccaagaagaagtcagacatcaagtggtacggcaagtacctcaacaaccctttgggacgcaccgtgatgttaacggttaagttcactctcggctggcctttgtacttag

SEQ ID NO: 13511 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgcctttgtacttag

SEQ ID NO: 13512 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaactcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13513 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaaatcctacatcaagtggtacggaaagtacctcaacaacccgctaggacgcacggtgatgctaaccgtccagttcacgctcggctggcctttgtacttag

SEQ ID NO: 13514 - DNA, 352 bp, Artificial
  Mutation in BnaA.FAD2.a introduced by TALE nuclease pair BnFAD2_T02
cctctcctccatcaccctctcccttacctcgcctggcccctctactgggcctgccagggctgcgtcctaaccggcgtctgggtcatcgcccacgaatgcggccaccacgccttcagcgaccaccagtggctggacgacgccgtgggcctcgtcttccactacttcctcctcgtcccttacttctcctggaatcgacgccaccattccaacaccggctccctcgagagggatgaagtgttcgtccccaagaagaagtcagacatcaagtggtacggcaagtacctcaacaaccctttgggacgcaccgtgatgttaacggttcagttcactctcggctgggctttgtactgag

SEQ ID NO: 13515 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13516 - DNA, 437 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaccgtctccagcggctgttgccggtgctgtgccaggcccacggcttgaccccggagcaggtggtggccatcgccatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13517 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13518 - DNA, 394 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacgccattgctggcgatggccaccacctgctggggggtcagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 13519 - DNA, 362 bp, Artificial
  Mutation in BnaA.FAD2.a introduced by TALE nuclease pair BnFAD2_T02
cctctcctcccttaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13520 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacagccctttgggacgcaccgtgaggttaacggttcagttcactctcggctggcctttgtacttag

SEQ ID NO: 13521 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13522 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttctcctggaaagtggctccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13523 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 13524 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcctctgggtcatagcccacgagtgcggccaccacgccttcagcgactaccagtggctggacgacaccgtcggcctcatcttccactccttcctcctcgtcccttacttctcctggacatcgacgccaccatgccaacactggcaccctcgagagagacgaggtgtttgcccccaagaagaagtcagccatcagtggttacggaaagtccccaaccaccccttagggacgcagcgtgatgttaacggttcattccactctcggctggctttggtactag

SEQ ID NO: 13525 - DNA, 372 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttactcaagtcagaggtggcgaaacccgacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13526 - DNA, 425 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttccactccatgcatgcactgcctttttgcgtttctacaaactcttcctggctagcggtacgcgtattaattgcgttgcgctcactgcccgctttccagtcatcgacgccaccatgccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13527 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggccgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggctggcctttgtacttag

SEQ ID NO: 13528 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccgctccttcctcctcgtcccttacttctcctggaagtaagtcatcgacgccaccattccaacactggctccctcgagagagacgaagtgtttgtccccaagaagaagtcagccatcaagtggtacggcaagtacctcaacaaccctttgggacgcaccgtgatgttaaccggtcagttcactctcggctggactttggacttag

SEQ ID NO: 13529 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaatatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13530 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcacagccatcgacgccaccattccaacactggctccctcgagagagacgaagtgtttgtccccaagaagaagtcagacatcaagtggtacggcaagtacctcaacaaccctttgggacgcaccgtgatgttaacggttaagttcactctcggctggcctttgtacttag

SEQ ID NO: 13531 - DNA, 460 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggttcggcgctgttgccggtgctgtgccatgcccacggcttgaccccccagcaggtggtggccatcgccagcaataatggtggcaagcaggcgctggagacggtccaagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 13532 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagttgctggacgacaccgtcggcctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13533 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatcgacgccaccattccaacactggctccctcgagagagacgaagtgtttgtccccaagaagaagtcagacatcaagtggtacggcaagtacctcaacaaccctgggggacgcaccgtgatgttaacggtgcagttcactctcggctggcctttgtacttag

SEQ ID NO: 13534 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacacccctttgggacgcaccgtgatgttaacggttcagtccactctcggctggcctttgtacttag

SEQ ID NO: 13535 - DNA, 345 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13536 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcaactaccagtggctggacgacaccgtcggcctcatcttccactccttcctcctcgtcccttacttctcctggaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 13537 - DNA, 323 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaagtaccgctcgccgcagccgaacgaccgagaagaagtcagacatcaagtggtacggcaagtacctcaacaaccctttgggacgcaccgtgatgttaacggttcagttcactctcggctggcctttgtacttag

SEQ ID NO: 13538 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcatcgtcccttacttctcctggacatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 13539 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13540 - DNA, 356 bp, Artificial
  Mutation in BnaA.FAD2.a introduced by TALE nuclease pair BnFAD2_T02
cctctcctccctcaccctctctcctacttcgcctggcccctctactgggcctgccagggctgcgtcctaaccagcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13541 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcatctgggtcatcgcccacgaatgcggccaccacgccttcagcgaccaccagtggctggacgacgccgtgggcctcgtcttccactccttcctcctcgtcccttacttctcctggaaggtcatcgacgccaccattccaacactggctccctcgagagagacgaagtgtttgtccccaagaagaagtcagacataaagtgatacgacaagtgcctcaacaaccctctgggacgcacagggatgttaacggttcagttcactctcggctggcctttgtacttag

SEQ ID NO: 13542 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtcttag

SEQ ID NO: 13543 - DNA, 394 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtattgagtgagctgataccgctcgccgcagccgaacagtcatagacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 13544 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcggctaccagtggctggacgacaccgtcggcctcatcttccactccttcctcctcgtcccttacttctcctagtcatcgacgccaccattccaacactggctccctcgagagagacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 13545 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacactggctccctcgagagagacgaagtgtttgtccccaagaagaagtcagacatcaagtggtacggcaagtacctcaacaaccctttgggacgcaccgtgattttaacggttcagttcactctcggctggcctttgtacttag

SEQ ID NO: 13546 - DNA, 356 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13547 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacatcgacgccaccattctaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13548 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgccaccgtcggcctcatcttccactccttcctcctcgtcccttacttctcctggaagtacatcgacgccaccattccaacactggctccctcgagagagacgaagtgtttgtccccaagaagaagtcagacatcaagtggtacggcaagtacctcaacaaccctttgggacgcaccgtgatgttaacggttcggttcactctcggctggcctttgtacttag

SEQ ID NO: 13549 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactta

SEQ ID NO: 13550 - DNA, 434 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgagtgcggccaccacgccttcagcgactaccagtggctggacgacaccgtcggcctcatcttccactccttcctcctcgtcccttacttctcctggaagtatggcggcaagcaggcgctggagacggtccagcggctgttgccggtgctgtgccaggcccacggcttgaccccccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13551 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgccaacgaatgcggccaccacgccttcagcgaccaccagtggctggacgacgccgtgggcctcgtcttccactccttcctcctcgtcccttacttctcctggaagtacacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 13552 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13553 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaaggcacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13554 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaagtcagccatcaagtggtacggcaagtacctcaacaacccgttgggacgcaccgtgatgttaacggtgcagttcactctcggctggcatttgtacttag

SEQ ID NO: 13555 - DNA, 360 bp, Artificial
  Mutation in BnaA.FAD2.a introduced by TALE nuclease pair BnFAD2_T02
cctctcctccctcaccctctctcctacctcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtacgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13556 - DNA, 342 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtccctgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13557 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatccagtggtacggcaagtacctcaacaaccctttgggacgcaccgtgatgttaacggttcagttcactctcggctggcctttgtacttag

SEQ ID NO: 13558 - DNA, 455 bp, Artificial
  Mutation in BnaA.FAD2.a introduced by TALE nuclease pair BnFAD2_T02
cctctcctccctcaccctctccattacctcgcctggcctctctactgggcctgccagggctgcgtcctaaccggcgtctgggtcatagcccacgagtgcggccaccacgccttcagcggctaccagtggcttgacgacaccgtcggcctcatcttccactccttcctcctcgtcccttacttctcctgacggtccagcgcctgcttgccggtgctgtgccaggcccacggcttgaccccccagcaggtggtggccatccccagcaatggcggtggcaagcgggcgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13559 - DNA, 425 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcccttaacgtgagttacgcgtcgttccactgagcgtcagaccccgtagaaaagatcaaaggatcttcttggtcgacgcaaccattccaacactggctccttcgagagagacgaagtgtttgtccacaagaagaagtcagacatcaagtggtacggcaagtacctcaacgaccttttgggacgcgccgtgtttttaacggttccgtccactctcggctgcccgttgtacttag

SEQ ID NO: 13560 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcgtcttccactccttcctcctcgtcccttacttctcctggaaaggcatcggcgccaccattccaacactggctccctcgagagagacgaactgtttgtccccaagaagaagtcagacatcaaatggtacggcaagtacctcaacagccctctgggacgcgccttgatcttaacggggcagttcactctcggctgaccttgtacttag

SEQ ID NO: 13561 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaaatcccacatcaagtggtacggaaagtacctcaacaacccgctaggacgcacggtgatgctaaccgtccagttcacgctcggctggcctttgtacttag

SEQ ID NO: 13562 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtacagtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 13563 - DNA, 400 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtgccaggcccacggcttgaccccggagcaggtggtggccatcgcctggcacagcaccggcaacagccgctggaccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13564 - DNA, 432 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaacagcggctgttgccggtgctgtgccaggcccacggcttgaccccccgggcccgggatccgatccaatgctatgaccatgattacgaattcccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13565 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13566 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13567 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 13568 - DNA, 356 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgtctaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtccggcaagtacctcaacaaccctttgggacgcaccgtgatgttaacggttcagttcactctcggctggcctttgtacttag

SEQ ID NO: 13569 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcctctgggtcatagcccacgagtgcggccaccacgccttcagcgactaccagtggctggacgacaccgtcggcctcatcttccactccttcctcctcgtcccttacttctcctggattcatcgacgccaccattccaacactggctccctcgagagagacgaagtgtttgtccccaagaagaagtcagacatcaagtggtacggcaagtacctcaacagcccgttgggacgcaccgtgaggttaacggttcagttcactctcggctggcctttgtacttag

SEQ ID NO: 13570 - DNA, 345 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacgccgtcggtctcatcttccactccttcctcctcgtcccttacttctcctggaagtacattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13571 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 13572 - DNA, 355 bp, Artificial
  Mutation in BnaA.FAD2.a introduced by TALE nuclease pair BnFAD2_T02
ctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13573 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13574 - DNA, 335 bp, Artificial
  Mutation in BnaA.FAD2.a introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttactcaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13575 - DNA, 348 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttcttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13576 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctccatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13577 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 13578 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggaaagtacctcaacaacccgctaggacgcacggtgatgctaaccgttcagttcactctcggctggcctttgtacttag

SEQ ID NO: 13579 - DNA, 356 bp, Artificial
  Mutation in BnaA.FAD2.a introduced by TALE nuclease pair BnFAD2_T02
cctctcctccctcaccctctctactacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacaccggatccctcgagagggatgaagtgttcgtccccaagaagaaatccgacatcaagtggtacggcaagtacctcaacaaccctttgggacgcaccgtgatgttaacggtgcaggtcactctcggcgggccgttgggcttag

SEQ ID NO: 13580 - DNA, 349 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13581 - DNA, 348 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttcttcatcgacgccaccattccaacactggctccctcgagagagacgaagtgtttgtccccaagaagaagtcagacatcaagtggtacggcaagtacctcaacaaccctttgggacgcaccgtgatgttaactgttcagttcactctcggctggcctttgtacttag

SEQ ID NO: 13582 - DNA, 321 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13583 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggcctcatcttccactccttcctcctcgtcccttacttctcctggaagttacagtcatcgacgccaccattccaacactgggtccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13584 - DNA, 370 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaagaaaaatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13585 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtcggcctcatcttccactccttcctcctcgtcccttacttctagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13586 - DNA, 363 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaagtatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13587 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgaccaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13588 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttggtacgcaccgtgatgttaacggttcagttcactctcggctggcctttgtacttag

SEQ ID NO: 13589 - DNA, 356 bp, Artificial
  Mutation in BnaA.FAD2.a introduced by TALE nuclease pair BnFAD2_T02
cctctcctccctcaccctgtctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgtgggacgcaccgtgaggttaacggttcagttcactttcggcgggccgttgtacttag

SEQ ID NO: 13590 - DNA, 359 bp, Artificial
  Mutation in BnaA.FAD2.a introduced by TALE nuclease pair BnFAD2_T02
cctctcctccctcaccctctcacttacctcgcctggcccatctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13591 - DNA, 395 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgtggccaccacgccttcagcgaccaccagtggctggacgacgccgtgggcctcgtcttccactccttcctcctcgtcccttacttctcctggaagttgaccccccagcaggtggtggccatcgccagccaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13592 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagtcatcgacgccaccattccaacactggctccctctagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13593 - DNA, 323 bp, Artificial
  Mutation in BnaA.FAD2.a introduced by TALE nuclease pair BnFAD2_T02
cctctcctccctcaccctctctcctacttcgcctggcctctctacttggcctgccaagggtgcgtcctaaccggcgtctgggtcatagcccacgagtgcggccaccacgccttcagtgactaccagtggctggacgacaccgtcggcctcatcttccactccttcctcctcgtcccttacttctcctggaagtaccgctcgccgcagccgaacgaccgagaagaagtcagacatcaagtggtacggcaagtacctcaacaacccgctaggacgcacggtgatgctaaccgtccagttcacgctcggctggcctttgtacttag

SEQ ID NO: 13594 - DNA, 315 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccaatggcggtggcaagcaggcgctggagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13595 - DNA, 345 bp, Artificial
  Mutation in BnaA.FAD2.a introduced by TALE nuclease pair BnFAD2_T02
cctctcctccctcaccctctcacctacttcgcctggcctctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaagtacattccaacactggctccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 13596 - DNA, 394 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccgctcgccatgcatgcactgcctccactgcggtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13597 - DNA, 423 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagttaggccaccacttcaagaactctgtagcaccgcctacatacctcgctctgctaatcctgttagccatcgacgccaccattccaacactggctccctcgagagagacgaagtgtttgtccccaagaagaagtcagacatcaagtggtacggcaagtacctcaacacccctgtgggacgcaccgtgatgttaacggttcagttcactctcggctggcctttgtacttag

SEQ ID NO: 13598 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaacccttggggacgcaccgtgatgttaacggttcaggtcactctcggctggcctttgtacttag

SEQ ID NO: 13599 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggaatcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 13600 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctgaaaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13601 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 13602 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 13603 - DNA, 336 bp, Artificial
  Mutation in BnaA.FAD2.a introduced by TALE nuclease pair BnFAD2_T02
cctctcctccctcaccctctcccttacctcgcctcacccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13604 - DNA, 356 bp, Artificial
  Mutation in BnaA.FAD2.a introduced by TALE nuclease pair BnFAD2_T02
cctctcctccctcaccctctctactacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctctaggacgcaccgtgatgttaacggttcagttcactctcggctggcctttgtacttag

SEQ ID NO: 13605 - DNA, 356 bp, Artificial
  Mutation in BnaA.FAD2.a introduced by TALE nuclease pair BnFAD2_T02
cctctcctccctcaccctgtcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcgagtacctcaacaaccgtttggaacggaccgtgaggtaaacccttcagttcacgctcggatggcctttgtacttag

SEQ ID NO: 13606 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13607 - DNA, 454 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctgacggtccagcggctgttgccggtgctgtgccaggcccacggcttgaccccccagcaggtggtggccatcgccagcaatggcggtggcaagcaggcgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13608 - DNA, 372 bp, Artificial
  Mutation in BnaA.FAD2.a introduced by TALE nuclease pair BnFAD2_T02
cctctcctccctcaccctctcccttacctcggctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttactcaagtcagaggtggcgaaacccgacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13609 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcccatcgacgccactattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13610 - DNA, 392 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggaagtgggcctggcacagcaccggcaagcaggcgctggagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgcacttag

SEQ ID NO: 13611 - DNA, 394 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaccgctcgccatgcatgcactgcctccactgcggtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13612 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 13613 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 13614 - DNA, 351 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcgacgccaccattccaacactggctccctcgagagagacgaagtgtttgtccccaagaagaagtcagacatcaagtggtacggcaagtacctcaacaaccctgggggacgcgccgtgatgttaacggttcaggtcactctcggctggcgtgtgtacttag

SEQ ID NO: 13615 - DNA, 357 bp, Artificial
  Mutation in BnaA.FAD2.a introduced by TALE nuclease pair BnFAD2_T02
cctctcctccctcaccctctctactacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccatcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13616 - DNA, 335 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcctctgggtcatcgcccacgaatgcggccaccacgccttcagcgactaccagtggctggacgacaccgtcggcctcatcttccactccttcctcctcgtcccttactcaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13617 - DNA, 355 bp, Artificial
  Mutation in BnaA.FAD2.a introduced by TALE nuclease pair BnFAD2_T02
cctctcctccctcaccctctctcctacttcgcctagcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacgaccctttgggacgcaccgtgaggttaacggttcagttccctctcggctggcctttgtacttag

SEQ ID NO: 13618 - DNA, 357 bp, Artificial
  Mutation in BnaA.FAD2.a introduced by TALE nuclease pair BnFAD2_T02
cctctcctccctcacactctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13619 - DNA, 347 bp, Artificial
  Mutation in BnaA.FAD2.a introduced by TALE nuclease pair BnFAD2_T02
cctctcctccctcaccctctcggctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13620 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaaatccgacatcaagtggtacggaaagtacctcaacaacccgctaggacgcacggtgatcctaaccgtccagttcacgctcggctggcctttgtacttag

SEQ ID NO: 13621 - DNA, 351 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctccttcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 13622 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13623 - DNA, 357 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13624 - DNA, 397 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaccagcggtggtttgtttgccggaaaaagagttggtacagtcatcgacgccaccattccaacactggctccctcgagagagacgaagtgtttgtccccaagaagaagtcagacatcaagtggtacggcaagtacctcaacagccctttgggacgcaccgtgatgttaacggttcagtgcactctcggctggcctttgtacttag

SEQ ID NO: 13625 - DNA, 336 bp, Artificial
  Mutation in BnaA.FAD2.a introduced by TALE nuclease pair BnFAD2_T02
cctctcctccctcaccctctctcctacttcgcctggcaactctactgggcctgccaagggtgcgtcctaaccggcgtctgggtcatagcccacaagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaggtcagacatcaagtggtacggcaagtacctcaacaaactgttgggacgcaccgtgatgttaacggtgcaggtcacgcttggctggcattagtacttag

SEQ ID NO: 13626 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 13627 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaatggtgcgtcctaaccggcgtctgggtcatagcccacgagtgcggccaccacgccttcagcgactaccagtggctggacgacaccgtcggcctcatcttccactccttcctcctcgtcccttacttctcctggaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13628 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 13629 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13630 - DNA, 353 bp, Artificial
  Mutation in BnaA.FAD2.a introduced by TALE nuclease pair BnFAD2_T02
cctctcctccctcaccctatctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13631 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctagacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 13632 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaacatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 13633 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13634 - DNA, 387 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaagggcctctgggtcatcgcccacgaatgcggccaccacgccttcagcgaccaccagtggctggacgacgccgtgggcctcgtcttccactccttcctcctcgtccctttgcctggcacagcaccggcaacagccgctggaccgtctccagctgtcatcgacgcaaccattccaacactggctccctcgagagagacgaagtgtttgtccccaagaagaagtcagacatcaagtggtacggcaagtacctcaacatccctttgggacgcaccgtgatgttaacggttcagttcactcgcggctggcctttgtacttag

SEQ ID NO: 13635 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 13636 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagttgtacggcaagtacctcaacaaccctttgggacgcaccgtgatgttaacggttcagttcactctcggctggcctttgtacttag

SEQ ID NO: 13637 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttactaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13638 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 13639 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13640 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtaaggcaagtacctcaacaaccctttgggacgcaccgtgatgttaacggttcagttcactctcggctggcctttgtacttag

SEQ ID NO: 13641 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtaaggcacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13642 - DNA, 413 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagttgcacagcaccggcaacagcgcctgcaccgtctccagcgcctgcttgccaccaatatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13643 - DNA, 354 bp, Artificial
  Mutation in BnaA.FAD2.a introduced by TALE nuclease pair BnFAD2_T02
cctctcctccctcaccctctctcctacttcgcctgacctctctactcggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaccatgacgccaccattccaacaccggatccctcgatagggacgaagtgttcgtccccaagaagaaatccgacatcaagtggtacggcaagtacctcaacaacccgctaggacgcacggtgatgctaaccgtccagttcaagctcggctggcctttgtacttag

SEQ ID NO: 13644 - DNA, 384 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagccacgatggcggcaagcaggcgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13645 - DNA, 404 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatctccagcgcctgcttgccaccgccattgctggcgatggccaccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13646 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtggctccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13647 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcctcttccactccttcctcctcgtcccttacttctagtcatcgacgccaccattccaacaccggctccctcgagagagacgaagtgtttgtccccaagaagaagtcagacatcaagtggtacggcaagtacctcaacaacccttcgggacgcaccgtgaggttaaccgtacagttcacgctcggctggcctttgtacttag

SEQ ID NO: 13648 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactttag

SEQ ID NO: 13649 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgctaaccgtccagttcacgctcggctggcctttgtacttag

SEQ ID NO: 13650 - DNA, 354 bp, Artificial
  Mutation in BnaA.FAD2.a introduced by TALE nuclease pair BnFAD2_T02
cctctcctccctcaccctgtcccttacctcgcctggccactctactgggcctgccaaggctgcgtcctaacgggcctctgggtcatcgcccacgaatgcggccaccacgccttcagcgactaccagtggctggacgacgccgtgggcctcgtcttccactccttcctcctcgtcccttacttctcctggaatatcgacgccaccattccaacactggctccctcgagagagacgaagtgtttgtccccaagaagaagtcagacatcaagtggtacggcaagtacctcaacagccttttgggacgcaccgtgaggttaacggttcagttcactctcggctggccgttgtacttag

SEQ ID NO: 13651 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatctacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13652 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacacccctttgggacgcaccgtgatgttaacggtgcagttcactctcggctggccttggtacttag

SEQ ID NO: 13653 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacctgcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13654 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13655 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagggatgaagtgttcgtccccaagaagaaatccgacatcaagtggtacggaaagtacctcaacaaccctttgggacgcaccgtgatgttaacggttcagttcacgctcggctggcctttgtacttag

SEQ ID NO: 13656 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgctaaccgtccagttcacgctcggctggcctttgtacttag

SEQ ID NO: 13657 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacaccaagtggtacggcaagtacctcaacatccctgtgggacgcaccgtgatgttaacggttcagttcactctcggctggcctttgtacttag

SEQ ID NO: 13658 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 13659 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaagtcatcgacgccaccattccaacactggctccctcgagagagacgaagtgtttttccccaagaagaagtcagacatcaagtggtacggcaagtacctcaacaaccctttgggacgcaccgtgatgttaacggttcagttcactctcggctggcctttgtacttag

SEQ ID NO: 13660 - DNA, 391 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacaatgttccagattacgctatcgatatcgccggccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13661 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13662 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13663 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13664 - DNA, 356 bp, Artificial
  Mutation in BnaA.FAD2.a introduced by TALE nuclease pair BnFAD2_T02
cctctcctccctcaccctctctcctacttcgcctggcatctctactgggcctgccagggctgcgtcctaaacggcgtctgggtcatagcccacgagtgcggccaccacgccttcagcgactaccagtggctggacgacaccgtcggcctcatcttccactccttcctcctcgtcccttacttctcctggatgtcatcgacgccaccattccaacactggctccctcgagagagacgaagtgtttgtccccaagaagaagtcagacatcaagtggtacggcaagtacctcaacaaccctgagggacacaccgtgatgttaccggttcatttccctctcggctggcctttgtacttag

SEQ ID NO: 13665 - DNA, 294 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtaatagcccacgagtgcggccaccacgccttcagcgactaccagtggctggacgacaccgtcggcctcatcttccactccttcctccttgtcaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13666 - DNA, 357 bp, Artificial
  Mutation in BnaA.FAD2.a introduced by TALE nuclease pair BnFAD2_T02
cctctcctccctcaccctctcacctacttcgcctggccactctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccacaattccaacactggctccctcgagagagacgaagtgtttgtccccaagaagaagtcagacatcaagtggtacggcaagtacctcaacaacccgttgggacgcaccgtgatgttaacgtttcagttcactctcggctggcctttgtacttag

SEQ ID NO: 13667 - DNA, 354 bp, Artificial
  Mutation in BnaA.FAD2.a introduced by TALE nuclease pair BnFAD2_T02
cctctcctccctcaccctctccattacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13668 - DNA, 315 bp, Artificial
  Mutation in BnaA.FAD2.a introduced by TALE nuclease pair BnFAD2_T02
cctctcctccctcaccctctcccttacctcgcctgccccctctactgggcctgccaaggctgcgtcctaacgggcctctgggtcatcgcccacgaatgcggccaccacgccttcagcgaccaccaatggccgtggcaagcaggcgctggagccatcgacgccaccattccaacactggctccctcgagagagacgaagtgtttgtccccaagaagaagtcagacagcaagtggtacggcaagtacctcaacatccctttgggactcaccgtgatgttaacggttcagttcactctcggctggcctttgtacttag

SEQ ID NO: 13669 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtgttacggcaagtacctcaacaaccctttgggacgcaccgtgatgttaacggttcagttcacgctaggctggcctttgtacttag

SEQ ID NO: 13670 - DNA, 387 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagtccacgagtgcggccaccacgccttcagcgactaccagtggctggacgacaccgtcggcctcatcttccactccttcctcctcgtcccttacttctcctgggcctggcacagcaccggcaacagccgctggacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13671 - DNA, 353 bp, Artificial
  Mutation in BnaA.FAD2.a introduced by TALE nuclease pair BnFAD2_T02
ccctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggagccatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtactta

SEQ ID NO: 13672 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacatccctttgggacgcaccgtgatgttaacggttcagttcacgctcggctggcctttgtgcttag

SEQ ID NO: 13673 - DNA, 349 bp, Artificial
  Mutation in BnaA.FAD2.a introduced by TALE nuclease pair BnFAD2_T02
cctctcctccctcaccctctcccttacctcgccttgcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttccgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacgtag

SEQ ID NO: 13674 - DNA, 353 bp, Artificial
  Mutation in BnaA.FAD2.a introduced by TALE nuclease pair BnFAD2_T02
cctctcctccctcaccctgtcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacatcgacgccaccattccaacactggctccctcgagagagacgaagtgtttgtccccaagaagaaggcagacatcaagtggtacggcaagtacctcaacaacccgttgggacgcaccgtgatgttaacgtttcagttgactctcggctggcctgtgtacgtag

SEQ ID NO: 13675 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 13676 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacactggctccctcgagagagacgaagtgtttgtccccaagaagaagtcagacatcaagtggtacggcaagtacctcaacatccctttgggacgcaccgtgatgttaacggttcagttcactctcggctggcctttgtacttag

SEQ ID NO: 13677 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagttacagtcatcgacgccaccattccaacactggctccctcgagagagacgaagtgtttgtccccaagaagaagtcagacatccagtggtacggcaagtacctcaacaaccctttgggacgcaccgtgatgttaacggttcagttcactctcggctggcctttgtacttag

SEQ ID NO: 13678 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 13679 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgcctttagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 13680 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgttggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13681 - DNA, 335 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttactcaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 13682 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcatcttccactccttcctcctcgtcccttacttctcctggtcatcgacgccaccattccaacactggctccctcgagagagacgaagtgtttgtccccaagaagaagtcaaacatcaagtggtacggcaagtacctcaacaaccctttgggacgcaccgtgatgttaacggttcagttcactctcggctggcctttgtacttag

SEQ ID NO: 13683 - DNA, 345 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctattccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13684 - DNA, 336 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggctggacgacaccgtcggcctcatcttccactccttcctcctcgtcatcgacgccaccattccaacactggctccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 13685 - DNA, 351 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13686 - DNA, 345 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13687 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13688 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaatcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 13689 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgaatgcggccaccacgccttcagcgaccaccagtggctggacgacgccgtgggcctcgtcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13690 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaagtcagacatcaagtggttcggcaagtacctcaacaaccctttgggacgcaccgtgatgttaacggttcagttcactctcggctggcctttgtacttag

SEQ ID NO: 13691 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacaccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 13692 - DNA, 353 bp, Artificial
  Mutation in BnaA.FAD2.a introduced by TALE nuclease pair BnFAD2_T02
cctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13693 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccctttgtacttag

SEQ ID NO: 13694 - DNA, 412 bp, Artificial
  Mutation in BnaA.FAD2.a introduced by TALE nuclease pair BnFAD2_T02
cctctcctccctcaccctctctactacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaagtgcacagcaccggcaacagccgctgggccaggaaccgtaaaaaggccgcgttgcagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 13695 - DNA, 318 bp, Artificial
  Mutation in BnaA.FAD2.a introduced by TALE nuclease pair BnFAD2_T02
cctcttctccctcaccctgtctcctacttcgcctggcttctccactgggcctgtcagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtagacgaagtgtttgtccccaagaagaattcagacatcaagtggtacggcaagtacctcaacatcccgctaggacgcacgctgatgctaaccgtccagttcacgctcggctggcctttgtacttag

SEQ ID NO: 13696 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13697 - DNA, 274 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccattccaacaccggatccctagagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13698 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaactcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13699 - DNA, 355 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13700 - DNA, 419 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgactaccagtggcttgacgacaccgtcggcctcatcttccactccttcctcctcgtcccttacttctcctggaagtacattccgtggcgttatccagctaagcgcgaactgcaatttggagaatggcagcgcaatgacacatcgacgccaccattccaacactggctccctcgagagagacgaagtgtttgtccccaagaagaagtcagacatcaagtggtacggcaagtacctcaacatccctttgggacgcaccgtgatgttaacggttcagttcactctcggctggcctttgtacttag

SEQ ID NO: 13701 - DNA, 354 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtccattacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13702 - DNA, 387 bp, Artificial
  Mutation in BnaA.FAD2.a introduced by TALE nuclease pair BnFAD2_T02
cctctcctccctcaccctctctactacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccaagccccccagcaggtggtggccatcgccagcaatagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13703 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 13704 - DNA, 353 bp, Artificial
  Mutation in BnaA.FAD2.a introduced by TALE nuclease pair BnFAD2_T02
cctctcctccctcaccctctctactacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtgcctcaacaaccctttgggacgcaccgtgatgttaacggttcagttcactctcggctggcctttgacttag

SEQ ID NO: 13705 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgaccaccagtggcttgacgacaccgtcggtctcatcttccactccttcctcctcgtcccttacttctcctggaagtcatcgacgccaccattccaacactggctccctcgagagagacgaagtgtttgtccccaagaagaaatccgacatcaagtggtacggaaagtacctcaacaacccgctaggatgcacggtgatgctaaccgtccagttcacgctcggctggcctttgtacttag

SEQ ID NO: 13706 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13707 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtgtcacggcaagtacctcaacaacccgctaggacgcacggtgatgctaaccgtccagttcacgctcggctggcctttgtacttag

SEQ ID NO: 13708 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtttttgtccccaagaagaagtcagacatcaagtggtacggcaagtacctcaacaaccctttgggacgcaccgtgatgttaacggttcagttcactctcggctggcctttgtacttag

SEQ ID NO: 13709 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggcagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 13710 - DNA, 349 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgacgaccagtggcttgacgacaccgtcggcctcatcttccactccttcctcctcgtcccttaatcgtgtcatcgacgccaccattccaacactggctccctcgagagagacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 13711 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13712 - DNA, 413 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacaatggccaccacctgctggggggtcaagccgtgggcctggcacagcaccggcagtcatcgacgccaccattccaacactggctccctagagagaaacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13713 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcgctctcggctggcctttgtacttag

SEQ ID NO: 13714 - DNA, 358 bp, Artificial
  Mutation in BnaA.FAD2.a introduced by TALE nuclease pair BnFAD2_T02
cctctcctccctcaccctctcccttacctcgcctggcccatctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaagccatcgacgccaccattccaacactggctccctcgagagagacgaagtgtttgtccccaagaagaagtcagacatcaagtggtacggcaagtacctcaacaacactttgggacgcaccgtgatgttaacggttcagttcactctcggctggcctttgtacttag

SEQ ID NO: 13715 - DNA, 405 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatgacggatggccttctgcttagtttgatgcctggcagtttatggcgggcgtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctgtgtacttag

SEQ ID NO: 13716 - DNA, 356 bp, Artificial
  Mutation in BnaA.FAD2.a introduced by TALE nuclease pair BnFAD2_T02
cctctcctccctcaccctctctcctacttcgcctggccactctactcggcctgccagggctgcgtcctaaccggcgtctgggtcatagcccacgagtgcggccaccacgcattcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaattacctcaacaaccctttgggacgcaccgtgatgttaacggttcagttcactctcggctggcctttgtacttag

SEQ ID NO: 13717 - DNA, 353 bp, Artificial
  Mutation in BnaA.FAD2.a introduced by TALE nuclease pair BnFAD2_T02
cctctcctccctcaccctctccattacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13718 - DNA, 347 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccacttcttcctcctcgtcccttacttctccacgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttagtacttag

SEQ ID NO: 13719 - DNA, 359 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaaaaaccctttgggacgcaccgtgatgttaacggttcagttcactctcggctggcctttgtacttag

SEQ ID NO: 13720 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 13721 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13722 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 13723 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 13724 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13725 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 13726 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13727 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccacaagaagaagtcagacatcaagtggtacggcaagtacctcaacaaccctttgggacgcaccgtgatgttaacggttcagttcactctcggctggcctttgtacttag

SEQ ID NO: 13728 - DNA, 364 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13729 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 13730 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 13731 - DNA, 357 bp, Artificial
  Mutation in BnaA.FAD2.a introduced by TALE nuclease pair BnFAD2_T02
ctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13732 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13733 - DNA, 372 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttactcaagtcagaggtggcgaaacccgacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 13734 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcgctctcggctggcatttgtacttag

SEQ ID NO: 13735 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggccatagcccacgagtgcggccaccacgccttcagcgactaccagtggctggacgacaccgtcggcctcatcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacagcccgctaggacgcacggtgatgctagccgtccagttcacgctcggctggccgtggtacttag

SEQ ID NO: 13736 - DNA, 343 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctggcacagcaccggcaacacccgctgggcagtcatcgacgccaccattccaacaccggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13737 - DNA, 391 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgggcctggcacagcaccggcaacagccgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13738 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 13739 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 13740 - DNA, 442 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacaggtcgttcgctccaagctgggctgtgtgcacgaaccccccgttaagacttctacagcgcggagaatctcgctctctccacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13741 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13742 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaatggttcagttcactctcggctggcctttgtacttag

SEQ ID NO: 13743 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcgacgccaccattccaacactggctccctcgagagatacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13744 - DNA, 370 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaagaaaaatacagtcatcgacgccaccattccaacactggctccctcgagagagacgaagtgtttgtccccaagaagaagtcagacatcaagtggtacggcaagtacctcaacaaccctttgggacgcaccgtgatgctaaccgtccagttcacgctcggctggcctttgtacttag

SEQ ID NO: 13745 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggattcatcgacgccaccattccaacactggctccctcgagagagacgaagtgtttgtccccaagaagaagtcagacaacaagtggtacggcgagtacctcaacaaccctttgggacgcaccgtgatgttaacggttcagttcactctcggctggcctttgtacttg

SEQ ID NO: 13746 - DNA, 357 bp, Artificial
  Mutation in BnaA.FAD2.a introduced by TALE nuclease pair BnFAD2_T02
cctctcctccctcaccctttctcctacttcgcctggcctctctactgcgcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggccatcgacgccaccattccaacaccgggtccctcgagagggatgaagtgttcgtccccaagaagaaatccaacatcaagtggtacggaaaggacctcaacaacccgctagaacgcacggtgatgctaaccggccaggtgactctctgctggccgttatacttag

SEQ ID NO: 13747 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggatcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttggacttag

SEQ ID NO: 13748 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgaccccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13749 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacggcaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13750 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttatccgtccagttcacgctcggctggcctttgtacttag

SEQ ID NO: 13751 - DNA, 358 bp, Artificial
  Mutation in BnaA.FAD2.a introduced by TALE nuclease pair BnFAD2_T02
cctctcctccctcaccctctctcctacttcccctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13752 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 13753 - DNA, 434 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaagtatggcggcaagcaggcgctggagacggtccagcggctgttgccggtgctgtgccaggcccacggcttgaccccccagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 13754 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13755 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcgagtggtacggcaagtacctcaacaaccctttgggacgcaccgtgatgttaacggttcagttcactctcggctggcctttgtacttag

SEQ ID NO: 13756 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagcatcgacgccaccattccaacactggctccctcgagagagacgaagtgtttgtccccaagaagaagtcagacatcaagtggtacggcaagtacctcaacatcccttggggacgcaccgtgatgttaacggtgcagttcactctcggctgccctttgtacttag

SEQ ID NO: 13757 - DNA, 362 bp, Artificial
  Mutation in BnaA.FAD2.a introduced by TALE nuclease pair BnFAD2_T02
cctctcctccctcaccctctcccttacctcgcctggcccccctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13758 - DNA, 455 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtccagcggctgttgccaccgccatttctggcgatgaccaccacctgctggggggtcaagccgtgggcctggcacagcaccggcaacaggcgctggacagtcatcgacgccaccattccaacactggctccctcgagagagacgaagtgtttgtccccaagaagaagtcagacatcaagtggtacggcaagtacctcaacaaccctttgggacgcatcgtgatgttaacggttcagttcactctcggctggcctttgtacttag

SEQ ID NO: 13759 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaaagtcatcgacgccaccattccaacactggctccctcgagagagacgaagtgtttgtccccaagaagaagtcagacatcaagtggtacgacaagtacctcaacaaccctttgggacgcaccgtgatgttaacggttcagttcactctcggctggcctttgtacttag

SEQ ID NO: 13760 - DNA, 345 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctattccaccattccaacacgggctccctcgagagagacgaagtgtttgtccccaagaagaagtcagacatcaagtggtacggcaagtacctcaacaaccctgtgggacgcaccgtgatgttaacggttcagttcactctcggcaggcattcgtacttag

SEQ ID NO: 13761 - DNA, 420 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgccgctgccaagttcgagagacagcacatggacagcatcgatgcctcgggcatccaagcacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 13762 - DNA, 354 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13763 - DNA, 354 bp, Artificial
  Mutation in BnaA.FAD2.a introduced by TALE nuclease pair BnFAD2_T02
cctctcctccctcaccctctctcctacttcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13764 - DNA, 347 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttatccatgacgccaccattccaacaccggatccctcgatagggacgaagtgttcgtccccaagaagaaatccgacatcaagtggtacggcaagtacctcaacaacccgctaggacgcacggtgatgctaaccgtccaggtcaagctcggctggccttagtacttag

SEQ ID NO: 13765 - DNA, 355 bp, Artificial
  Mutation in BnaA.FAD2.a introduced by TALE nuclease pair BnFAD2_T02
cctctcctccctcaccctctcccttacctctcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13766 - DNA, 389 bp, Artificial
  Mutation in BnaA.FAD2.a introduced by TALE nuclease pair BnFAD2_T02
cctctcctccctcaccctttctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtatggtggccatcgccagcaatggcggtgacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 13767 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgttcgtccccaagaagaagtccgacatcaagtggtacggcaagtacctcaacaaccctttaggacgcacggtgatgctaaccgttcagttcacgctcggctggcctttgtacttag

SEQ ID NO: 13768 - DNA, 355 bp, Artificial
  Mutation in BnaA.FAD2.a introduced by TALE nuclease pair BnFAD2_T02
cctctcctccctcaccctctctcctacttcgcctggcctctctactcggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaaatccgacatcaagtggtacggcaagtacctcaacaaccctttgggacgcaccgtgatgttaacggtgcagttcactctcggctggcctttgtacttag

SEQ ID NO: 13769 - DNA, 405 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatgacggatggccttctgcttagtttgatgcctggcagtttatggcgggcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13770 - DNA, 359 bp, Artificial
  Mutation in BnaA.FAD2.a introduced by TALE nuclease pair BnFAD2_T02
gctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagttgtcatcgacgccaccattccaacactggctccctcgagagagacgaagtgcttgtccccaagaagaaatccgccatcaagtggtacggaaagtacctcaacaccccgctaggacgcacggtgatgctaaccgtccagttcacgctcggctggcctttgtacttag

SEQ ID NO: 13771 - DNA, 356 bp, Artificial
  Mutation in BnaA.FAD2.a introduced by TALE nuclease pair BnFAD2_T02
cctctcctccctcaccctctctcctacttctcctggcctctctactgtgcctgccagggctgcgtcctaaccggcgtctgggtcatagcccacgagtgcgtccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaaatccgacatcaagtggtacggaaagtacctcaccaacccgctaggacgcacggtgatgctaaccgtcccgttcacgctcggctggcctttgtacttag

SEQ ID NO: 13772 - DNA, 356 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13773 - DNA, 346 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacagtcatcgacgccaccattccaacactggctccctcgagagggatgaagtgttcgtccccaagaagaaatccgacatcaagtggtacggaaagtacctcaacaacccgctaggacgcccggtgatgctaaccgtccagttcacgctcggctggcctttgtacttag

SEQ ID NO: 13774 - DNA, 345 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtacattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13775 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 13776 - DNA, 324 bp, Artificial
  Mutation in BnaA.FAD2.a introduced by TALE nuclease pair BnFAD2_T02
cctctcctccctcaccctctcccttacctcgcctggcaactctactgagcctgccaaggctgcgtcctaacggccctctgggtcatcgcccacgaatgcggccaccacgccttcagcgaccaccagtggctggacgacgccgtgggcctcgtcttccactccctcgacgccaccattccaacaccggatccctcgagagagacgaagtgtttgtccccaagaagaagtcagacatcaagtggtacggcaagtacctcaacaaccttttgggacgcaccgtgaggttaacgtttcagttcactctcggctggcctttgtacttag

SEQ ID NO: 13777 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaacattgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13778 - DNA, 387 bp, Artificial
  Mutation in BnaA.FAD2.a introduced by TALE nuclease pair BnFAD2_T02
cctctcctccctcaccctctctcctacttcgcctggcctctctactgggcctgccaagggcgcgtcctaaccggcgtctgggtcatagcccacgagtgcggccaccacgccttcagcgactaccagtggctggacgacaccgtcggcctcatcttccactccttcctcctcgtcccttacttctcctgggcctggcacagcaccggcaacagccgctggacagtcatcgacgccaccattccaacactggctccctcgagagagacgaagtgtttgtccccaagaagaagtcagacatgaagtggtacggcaagtacctcaacaaccctttgggacgcaccgtgatgttaacggttcagttcactctcggctggcctttgtacttag

SEQ ID NO: 13779 - DNA, 351 bp, Artificial
  Mutation in BnaA.FAD2.a introduced by TALE nuclease pair BnFAD2_T02
ccctcctccctcaccatctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactttag

SEQ ID NO: 13780 - DNA, 415 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacatctcaactctcccgccaccgtgagcaaggcctccagagcgcgtgcgccggaccagtcatcgacgccaccattccaacactggctccctcgagagagacgaagtgtttgtccccaagaagaagtcagacatcaagtggtacggcatgtacctcaacagccctttgggacgcaccgtgatgttaacggttcagttcactctcggctggcctttgtacttag

SEQ ID NO: 13781 - DNA, 311 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcgtctttgtccccaagaagaagtcagacatcaagtggtacggcaagtacctcaacaaccctttgggacgcaccgtgatgttaacggttcagttcactctcggctggcctttgtacttag

SEQ ID NO: 13782 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaagtgtcatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13783 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctcactcgagagagacgaagtgtttgtccccaagaagaagacagacatcaagtggtacggcaagtacctcaacaaccctttgggacggaccgtgatgataacggttcagttcactatcggctggcctttgtacgtag

SEQ ID NO: 13784 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 13785 - DNA, 332 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13786 - DNA, 359 bp, Artificial
  Mutation in BnaA.FAD2.a introduced by TALE nuclease pair BnFAD2_T02
cctctcctccctcaccctctctcctacttcgcctggcatctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttgtcatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggccttggtacttag

SEQ ID NO: 13787 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaaagtcatcgacgccaccattccaacactggctccctcgagagagacgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 13788 - DNA, 359 bp, Artificial
  Mutation in BnaA.FAD2.a introduced by TALE nuclease pair BnFAD2_T02
cctctcctccctcaccctgtctactacttcgcctggcctctctactgggcctgccagggctgcgtcctaaccggcgtctgggtcatagcccacgagtgcggccaccacgccttcagcgactaccagtggctggacgaccccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13789 - DNA, 448 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctccgtggcggcgtgaccgcagtggaggcagtgcatgcatggcgccgatctacgcacgctcggctacagccagcagcaacaggagaagatcaaaccgaaggttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttac

SEQ ID NO: 13790 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgtgtcctaaccggcgtctgggtcatagcccacgagtgcggccaccacgccttcagcgactaccagtggctggacgacaccgtcggcctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13791 - DNA, 332 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaactggcgccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13792 - DNA, 316 bp, Artificial
  Mutation in BnaA.FAD2.a introduced by TALE nuclease pair BnFAD2_T02
cctctcctcctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagagagacgaagtgtttgtcccaaagaagaagtcagacatcaagtggtacggcaagtacctcaacaaccctttgggacgcaccgtgatgttaacggttcagttcactctcggctggcctttgtacttg

SEQ ID NO: 13793 - DNA, 394 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacgccattgctggcgatggccaccacctgctggggggtcagtcatcgacgccaccattccaacactggctccctcgagagggatgaagggttcgtccccaagaagaaatccgacatcaagtggtacggaaagtacctcaacaacccgctaggacgcccggtgatgctaaccgtccagttcacgcgcggctggcctttgtacttag

SEQ ID NO: 13794 - DNA, 357 bp, Artificial
  Mutation in BnaA.FAD2.a introduced by TALE nuclease pair BnFAD2_T02
cctctcctccctcaccatctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatgtcatcgacgccaccattccaatactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 13795 - DNA, 399 bp, Artificial
  Mutation in BnaA.FAD2.a introduced by TALE nuclease pair BnFAD2_T02
cctctcctccctcaccctctctcctacttcgccttgcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtagccgaagtttccaaaaggtcgttgatcaaagctcgccgcgttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13796 - DNA, 360 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggaagtcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13797 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactta

SEQ ID NO: 13798 - DNA, 291 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13799 - DNA, 427 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacaaggcggtaatacggttatccacagaatcaggggataacgatatcgatgctgtccatgtgctgtacagccatcgacgccaccattccaacactggctccctcgagagagacgaagtgtttgtccccaagaagaagtcagacatcaagtggtacggcaagtacctcaacaaccctttgggacgcacggtgatgttaacggttcagttcactctcggctggccttggtacttag

SEQ ID NO: 13800 - DNA, 413 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacaatggccaccacctgctggggggtcaagccgtgggcctggcacagcaccggcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13801 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtactaaccggcgtctgggtcatagcccacgagtgcggccaccacgcctttagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13802 - DNA, 412 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgcacagcaccggcaacagccgctgggccaggaaccgtaaaaaggccgcgttgcagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13803 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctgaacgacaccgtcggtctcatcttccactccttcctcctcgtcccttacttctcctggaaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13804 - DNA, 354 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13805 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctgtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13806 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtaccgcaacaaccctttgggacgcaccgtgatgttaacggttcagttcactctcggctggccgttgtacttag

SEQ ID NO: 13807 - DNA, 358 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctctgggacgcatcggggtgtgaacggtccagctcactctcggctggcctttgtacttag

SEQ ID NO: 13808 - DNA, 379 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcgtctgggtcatagcccacgagtgcggccaccacgccttcagcgactaccagtggctggacgacaccgtcggcctcatcttccactccttcctcctcgtcccttacttctcctggtcgttcggctgcggcgagcggtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13809 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13810 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13811 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13812 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccctcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaagcctttgggacgcaccgtgatgttaacggttcagttcactctcggctggcctttgtacttag

SEQ ID NO: 13813 - DNA, 326 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 13814 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggctggcctttgtacttag

SEQ ID NO: 13815 - DNA, 273 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13816 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccactacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13817 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcccatcgacgccaccattccaacactggctccatcgagagagacgaagtgtttgtccccaagaagaagtcagacatcaagtggtacggcaagtacctcaacaaccctttgggacgcaccgggatgttaacggttcagttcactctcggctggccttagtacttag

SEQ ID NO: 13818 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccttgaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13819 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccatggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13820 - DNA, 336 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13821 - DNA, 348 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgaccaccagtggctggacgacgccgtgggcctcgtcttccactccttcctcctcgtcccttacttctcctggaacgccaccattccaacaccggatccctcgagagggatgaagttttcgtccccaagaagaaatccgacatcaagtggtacggaaagtacctcaacaacccgttggaacgccccgggatgttaacggttcagttcactcgcggctggccagagtacttag

SEQ ID NO: 13822 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13823 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgtcatcgacgccaccattccaacactggctccctctagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13824 - DNA, 370 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaagaaaaatacagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 13825 - DNA, 348 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttcttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13826 - DNA, 329 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactaccagtcatcgacgccaccattccaacactggctccctcgagagagacgaagtgtttgtccccaagaagaagtcagacatcaagtggtacggcaaatacctcaacaaccctttggaacgcaccgtgatgttaacggttcagttcactctcggctggccgttgtacttag

SEQ ID NO: 13827 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 13828 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtaatgttaacggttcagttcactctcggctggcctttgtacttag

SEQ ID NO: 13829 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13830 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggcagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 13831 - DNA, 364 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactcctccctcctcgtcccttacttctcctggaagttacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13832 - DNA, 419 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggatctccagcggctgttgccggtgctgtgccaggcccacggcttgacccctcagcaggtggtggcagtcatcgacgccaccattccaacactggctccctcgagagagacgaagtgtttgtccccaagaagaagtcagacatcaagtggtactgcaagtacctcaacaaccctttgggacgcaccgtgatgttaacggttcagttcactctcggctggcctttgtacttag

SEQ ID NO: 13833 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagtccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttatcggttcagttcactctcggctggccgttgtacttag

SEQ ID NO: 13834 - DNA, 355 bp, Artificial
  Mutation in BnaA.FAD2.a introduced by TALE nuclease pair BnFAD2_T02
ccctcctccctcaccctctcccttacctcgcctggcccctctactgggcctgccaaggctgcgtcctaacgggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcagcgtgatgttaacggttcagttcactctcggctggccgttgtgcttag

SEQ ID NO: 13835 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctgacgacgccgtgggcctcgtcttccactccttcctcctcgtcccttacttctcctggaatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13836 - DNA, 346 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13837 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaaggtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 13838 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13839 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13840 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13841 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 13842 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactta

SEQ ID NO: 13843 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggtgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagatatccgacatcaagtggtacggaaaatacctcaacaacccgctagaacgaacggtgatgctaaccgtacagttcacgcccggctggccgttgtacttag

SEQ ID NO: 13844 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctgaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13845 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccatcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 13846 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttactaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13847 - DNA, 339 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13848 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagacagacatcaagtggtacggcaagtacctcaacaaccctttgggtcgcaccgggatgttaacggttcagttcactctcggctggcctttgtacttag

SEQ ID NO: 13849 - DNA, 400 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtctccaaattgcagttcgcgcttagctggataacgccacggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13850 - DNA, 340 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtacaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13851 - DNA, 273 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacaaatgcggccaccacgccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 13852 - DNA, 322 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13853 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctgaacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13854 - DNA, 356 bp, Artificial
  Mutation in BnaA.FAD2.a introduced by TALE nuclease pair BnFAD2_T02
cctctcctccctcaccctctcccttacctcgcctggcccctctactcggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13855 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaaatccgacatcaagtggtacggcaagtacctcaacaaccctttgggacgcaccgtgatgttaacggttcagttcactctcggctggcctttgtacttag

SEQ ID NO: 13856 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtacagccatcgacgccaccattccaacaccggatccctcgagagagacgaagtgtttgtccccatgaagaagtcagacatcaagtggtacggcaagtacctcaacaaccctttgggacgcaccgtgatgttaacggttcagttcactctcggctggcctttgtacttag

SEQ ID NO: 13857 - DNA, 358 bp, Artificial
  Mutation in BnaA.FAD2.a introduced by TALE nuclease pair BnFAD2_T02
cctctcctccctcaccctctctcctacttcgcctggcctctctactgggcctgtcaagggtgcgtcctaaccggcctctgggtcatcgcccacgaatgcggccaccacgccttcagcgaccaccagtggctggacgacgccgtgggcctcgtcttccactccttcctcctcgtcccttacttctcctggaagagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13858 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13859 - DNA, 365 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcgtcttccactccttcctcctcgtcccttacttcctcctcgtcccttacttctcatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 13860 - DNA, 467 bp, Artificial
  Mutation in BnaA.FAD2.a introduced by TALE nuclease pair BnFAD2_T02
cctctcctccctcaccctctcccttacctcacctggcccctctactgggcctgccaaggctgcgtcctaacgggcctctgggtcatcgcccacgaatgcggccaccacgccttcagcgaccaccagtggctggacgacgccgtcggtctcatcttccactccttcctcctcgtcccttacttctcctggaagtggaaagcgggcagtgagcgcaacgcaattaagctcgccgcgttgtttcatcaagccttacggtcaccgtaaccagcaaatcaatatcactgtgtggcttcaggccgccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13861 - DNA, 389 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatggtggccatcgccagcaatggcggtgacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13862 - DNA, 434 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtatggcggcaagcaggcgctggagacggtccagcggctgttgccggtgctgtgccaggcccacggcttgaccccccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13863 - DNA, 412 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgctgaaccacatcaccaactgcaacggcgccgtgctgtccgtggaggagctccagccatcgacgccaccattccaacactggctccctcgagatagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13864 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggctggacgacaccgtcggcctcatcttccactccttcctcctcgtcccttacttctcctggaagtacaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13865 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgcgtcatagccaacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaaaaaatcagacatcaagtggtacggcaagtacctgaacagcccgatggggagcaccgtgatgctaacggttcattgcactctcggctggcctttgtacgtag

SEQ ID NO: 13866 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcccatcgacgccaccattccaacactggctccctcgagagagacgaagtgtttgtccccaagaagaagtcagacatcaagtggtacggcaagtacctcaacaaccctttgggacgcaccgttatgttaacggttcagttcactctcggctggcctttgtacttag

SEQ ID NO: 13867 - DNA, 352 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 13868 - DNA, 356 bp, Artificial
  Mutation in BnaA.FAD2.a introduced by TALE nuclease pair BnFAD2_T02
cctctcctccctcaccctctcccctacttcgcctggcctctctactgggcctgccagggctgcgtcctaaccggcgtctgggtcatcgcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13869 - DNA, 411 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacgcgtaccgctagccaggaagagtttgtagaaacgcaaaaaggccatccccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttagtacttag

SEQ ID NO: 13870 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13871 - DNA, 359 bp, Artificial
  Mutation in BnaA.FAD2.a introduced by TALE nuclease pair BnFAD2_T02
cctctcctccctcaccctctctcctacttcgcctggccaccctactgggcctgccagggctgcgtcctaaccggcgtctgggtcatcgcccacgagtgcggccaccacgccttcagcgactaccagtggctggccgacaccgtcgggctcatcttccactccttcctcctcgtcccttacttctcctggaagaagccatcgacgccaccattccaacactggctccctcgagagagacgaagtgtttgtccccaagaagaagtcagacatcaagtggtacggcaagtacctcaacaacccgctaggacgcacggtgatgctaaccgtccatttcacgctcggctggcctgtgtacttag

SEQ ID NO: 13872 - DNA, 443 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctgcgatggccaccacctgctggggggtcaagccgtgggcctggcacagcaccggcaacagccgctggaccgtctccagcgcctgcttgtgcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13873 - DNA, 379 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggctccgcccccctgacgagcatcacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13874 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgcctttagcgactaccagtggctggacgacaccgtcggcctcatcttccactccttcctcctcgtcccttacttctcttggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13875 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgatagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13876 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgccggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 13877 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgtccacgaatgcggccaccacgccttcagcgaccaccagtggctggacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13878 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgtgacgcaccgtgatgttaacggttcagttcactctcggctggcctttgtacttag

SEQ ID NO: 13879 - DNA, 407 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaattccgactgggcctttcgttttatttgatgcctggcagttccctactctcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13880 - DNA, 353 bp, Artificial
  Mutation in BnaA.FAD2.a introduced by TALE nuclease pair BnFAD2_T02
cctctcctccaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 13881 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 13882 - DNA, 348 bp, Artificial
  Mutation in BnaA.FAD2.a introduced by TALE nuclease pair BnFAD2_T02
cctctcctccctcaccctctctcctacttcgcctggcctctctactgggcctgccagggctgtgtcctaaccggcgtctgggtcatagcccacgagtgcggccaccacgccttcagcgactaccagtggcttgacgacaccgtcggtctcatcttccactccttcctcctcgtcccttacttctccatcgacgccaccattccaacactggctccctcgagagagacgaagtgtttgtccccaagaagaagtcagacatcaagtggtacggcaagtacctcaacaaccctttgggacgcaccgtgatgttaacggttcagttctctctcggctggcctttgtacttag

SEQ ID NO: 13883 - DNA, 382 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtctccagcggctgttgccggtgccagtcatcgacgccaccattccaacactggctccctcgagagagacgaagtgtttgtccccaagaagaagtcagacatcaagtggtacggcaagtacctcaacaacccggtgggacgcaccgtgatgttaacggttcagttcactctcggctggccttggtacttag

SEQ ID NO: 13884 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttccgtcatcgacgccaccattccaacactggctccctcgagagagacgaagtgtttgtccccaagaagaagtcagacatcaagttgtacggcaagtacctcaacaaccctttgggacgcaccgtgatgttaacggttcagttcactctcggctggcctttgtacttag

SEQ ID NO: 13885 - DNA, 357 bp, Artificial
  Mutation in BnaA.FAD2.a introduced by TALE nuclease pair BnFAD2_T02
cccctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13886 - DNA, 352 bp, Artificial
  Mutation in BnaA.FAD2.a introduced by TALE nuclease pair BnFAD2_T02
cctctcctccctcaccctctcccttacctcgcctggcccctcgactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13887 - DNA, 379 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgtgtcatcgcccacgagtgcggccaccacgccttcagcgaccaccagtggctggacgacgccgtgggcctcgtcttccactccttccactccttacttactcgtcccctacaacctgcccatcggccaggccgacgccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13888 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgagtgcggccaccacgccttcagcgactaccagtggctggacgacgccgtgggcctcgtcttccactccttcctcctcgtcccttacttctcctggaaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcacgctcggctggcctttgtacttag

SEQ ID NO: 13889 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctccagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13890 - DNA, 359 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13891 - DNA, 356 bp, Artificial
  Mutation in BnaA.FAD2.a introduced by TALE nuclease pair BnFAD2_T02
cctctcctccctcaccctctctcctacttcgcctggactctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccttggggacgcgccgtgatgttaacggttcagttcactctcggctggcctttgtacttag

SEQ ID NO: 13892 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13893 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaatggttcagttcactctcggctggcctttgtacttag

SEQ ID NO: 13894 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccacctcgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaacccgctgggacgcaccgtgatgctaacggttcagttcactctcggctggcctttgtacttag

SEQ ID NO: 13895 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctatcgacgccaccattccaacactggctccctcgagagagacgaagtgtttgtccccaagaagaagtcagacatcaagtggtactgcaagtacctcaacaaccctttgggacgcaccgtgatgttaacggttcagttcactctcggctggccgttgtacttag

SEQ ID NO: 13896 - DNA, 356 bp, Artificial
  Mutation in BnaA.FAD2.a introduced by TALE nuclease pair BnFAD2_T02
cctctcctccctcaccctctctcctacttcgcctggcaactctactaggcctgccagggctgcgtcctaaccggcgtctgggtcatagcccacgagtgcggccaccacgaattcagcgactaccagtggctggacgacaccgtcggtctcatcttccactccttcctcctcgtcccttacttctcctggaagtcatcgacgccacatttccaacactggctccctcgggagagacgagggggttctccccaagaagaagtccgacatcaagtggtacgacaggtaccactacaaaccgttggaacgccccgggatgttatcggttcatttgacttgcggctggcaatagtacttag

SEQ ID NO: 13897 - DNA, 360 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 13898 - DNA, 332 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13899 - DNA, 394 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacgccattgctggcgatggccaccacctgctggggggtcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13900 - DNA, 318 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13901 - DNA, 420 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtactggaccgtctccagcgcctgcttgaaagataccaggcgtttccccctggaagctccctcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13902 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13903 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacactggctccctcgagagagacgaagtgtttgtccccaagaagaagtcagacatcaagtggtacggcaagtaccgcaacaaccctttgggacgcaccgtgatgttaacggttcagttcactctcggctggcctttgtacttag

SEQ ID NO: 13904 - DNA, 394 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccgctcgccatgcatgcactgcctccactgcggtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtgcttag

SEQ ID NO: 13905 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggatgcaccgtgatgttaacggttcagttcacgctcggctggcctttgtacttag

SEQ ID NO: 13906 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13907 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacatcgacgccaccattccaacactggctccctcgagagagacgaagtgtttgtccccaagaagaagtcagacatcaagtggtacggcaagtacctcaacaaccctttgggacgcgccgtgatgttaacggttcagttcgctctcggctggcctttgtacttag

SEQ ID NO: 13908 - DNA, 347 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctccacgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13909 - DNA, 419 bp, Artificial
  Mutation in BnaA.FAD2.a introduced by TALE nuclease pair BnFAD2_T02
cctctcctccctcaccctctctcctacttcgcctggccactctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacattccgtggcgttatccagctaagcgcgaactgcaatttggagaatggcagcgcaatgacacatcgacgccaccattccaacactggctccctcgagagagacgaagtgtttgtccccaagaagaagtcagacatcaagtggtacggcaagtacctcaacaacccgctaggacgcactgtgatgctaaccgtccagttcacgctcggctggcctttgtacttag

SEQ ID NO: 13910 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccagaaggcatcgacgccaccattccaacacgggctccctcgagagagacgaagtgtttgtacccaagaagaagtcaaacatcgagtaatacggcaagtacctcaacacccttctgggacgcccagtgatattaacggttcagttcacttgcggctggccttagtacttag

SEQ ID NO: 13911 - DNA, 419 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgctgccaccacgccttcagcgactaccagtggctggacgacaccgtcggcctcatcttccactccttcctcctcgtcccttacttctcctggaagtacattccgtggcgttatccagctaagcgcgaactgcaatttggagaatggcagcgcaatgacacatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 13912 - DNA, 394 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgccaccattattgctggcgatggccaccacctgctagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13913 - DNA, 387 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtccctttgcctggcacagcaccggcaacagccgctggaccgtctccagctgtcatcgacgcaaccattccaacactggctccctcgagagagacgaagtgtttgtccccaagaagaagtcagacatcaagtggtaaggcaagtacctcaacaaccctttgggacgcaccgtgatgttaacggttcagttcactctcggctggcctttgtacttag

SEQ ID NO: 13914 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacaccgtcggcctcatcttccactccttcctcctcgtcccttacttctcctggaaaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13915 - DNA, 412 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaattaggccaccacttcaagaactctgtagcaccgcctacatacctcgctctgctacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13916 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgtaccgtgatgttaacggttcagttcactctcggctggcctttgtacttag

SEQ ID NO: 13917 - DNA, 335 bp, Artificial
  Mutation in BnaA.FAD2.a introduced by TALE nuclease pair BnFAD2_T02
cctctcctccctcaccctctcccttacctcggctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttactcaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13918 - DNA, 343 bp, Artificial
  Mutation in BnaA.FAD2.a introduced by TALE nuclease pair BnFAD2_T02
cctctcctccctcaccctctcccttacctcgcctggcacctctactgggcctgccaaggctgcgtcctaacgggcctctgggtcatcgcccacgaatgcggccaccacgccttcagcgaccaccagtggctggacgacgccgtgggcctggcacagcaccggcaacagccgctggacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttggtacttag

SEQ ID NO: 13919 - DNA, 419 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatctccagcggctgttgccggtgctgtgccaggcccacggcttgacccctcagcaggtggtggcagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 13920 - DNA, 354 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggcttgacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13921 - DNA, 351 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttagtacttag

SEQ ID NO: 13922 - DNA, 362 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 13923 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagaacctcaacaaccctttgggacgcaccgtgatgttaacggttcagttcactctcggctggcctttgacttag

SEQ ID NO: 13924 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13925 - DNA, 352 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13926 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacagcaagtggtacggcaagtacctcaacagccgtgtgggacgcgccgtgatgttaacggttcagttcactctcggctgggctgtgtactgag

SEQ ID NO: 13927 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggtcgcaccgtgatgttaacggtacagttcactctcggctggcctttgtacttag

SEQ ID NO: 13928 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgagtgcggccaccacgccttcagcgactaccagtggctggacggcaccgtcggcctcatcttcccctccttcctcctcgtcccttacttctcctggaagcagtcatcgacgccaccattccaacactggctccctcgagagagacgaagtgtttgtccccaagaagaagtcagacatcaagtggttcggcaagtacctcaacaaccctttgggacgcaccgtgatgttaacggttcagttcactctcggctggcctgtgtacgtag

SEQ ID NO: 13929 - DNA, 356 bp, Artificial
  Mutation in BnaA.FAD2.a introduced by TALE nuclease pair BnFAD2_T02
cctctcctccctcaccctctcccttacctcgcctggccactctactgggcctgccaagggtgcgtcctaaccggagtctgggtcatagcccacgagtgcggccaccacgccttcagccactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13930 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacaccggatccctcgagagagacgaagtgtttgtccccaagaagaagtcagacatcaagtggtacggcaagtacctcaacagccctttgggacgcaccgtgatgttaacggttcagttcactctcggctggccgtggtacttag

SEQ ID NO: 13931 - DNA, 400 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgccaggcccacggcttgaccccggagcaggtggtggccatcgcctggcacagcaccggcaacagccgctggaccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13932 - DNA, 358 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13933 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggcttcctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 13934 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctgtacgacaccgtcggcctcatcttccactccttcctcctcgtcccttacttctcctggaagtcatcgacgccaccattccaacactggctccctcgagagagacgaagtgttcgtccccaagaagaaatccgacatcaagtggtacggaaagtaccgcaacaacccgctaggacgcacggtgatgctaaccgtccagttcacgctcggctggccgttgtacttag

SEQ ID NO: 13935 - DNA, 384 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaaccggcgtctgggtcatcgcccacgagtgcggccaccacgccttcagcgactaccagtggctggacgacaccgtcggtctcatcttccactccttcctcctcgtcccttacttctcctggaagccccgctggcggcacccccacgccggagccatcgacgccaccattccaacactggctccctcgagagagacgaagtgtttgtccccaagaagaagtcagacatcaagtggtacggaaagtacctcaacaacccgttgggacgcacggtgatgctaacggttcagttcacgctcggctggcctttgtacttag

SEQ ID NO: 13936 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcgccgtgatgttagcggttcagttcactctcggctggccgttgtacttag

SEQ ID NO: 13937 - DNA, 358 bp, Artificial
  Mutation in BnaA.FAD2.a introduced by TALE nuclease pair BnFAD2_T02
cctctcctccctcaccctctctcccacttcgcctggactctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13938 - DNA, 458 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagcggtccagcggctgttgccaccatcattgctggcgatggccaccacctgctggggggtcaagccgtgggcctggaccagcaccggcaacagccgctggagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13939 - DNA, 360 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13940 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13941 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 13942 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttaagcgaccaccagtggctggacgacgccgtgggcctcgtcttccactccttcctcctcgtcccttacttctcctggaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13943 - DNA, 387 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctgggcctggcacagcaccggcaacagccgctggacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 13944 - DNA, 352 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctgaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13945 - DNA, 351 bp, Artificial
  Mutation in BnaA.FAD2.a introduced by TALE nuclease pair BnFAD2_T02
cctctcctccctcaccctctcccttacctcgcctggcccctctactgggcctgccaaggccgcgtcctaacgggcctctgggtcatcgcccacgaatgcggccaccacgccttcagcgaccaccagtggctggacgacgccgtgggcctcgtcttccactccttcctcctcgtcccttacttctcctgcatcgacgccaccattccaacaccggatccctcgagagagacgaagtgtttgtccccaagaagaagtcagacatcgagtggtacggcaagtacctcaacatccctttgggacgcaccgtgagtttaacggttcagttcactctcggctggccttagtacttag

SEQ ID NO: 13946 - DNA, 355 bp, Artificial
  Mutation in BnaA.FAD2.a introduced by TALE nuclease pair BnFAD2_T02
cctctcctccctcaccctctctcctacttcgcctggcctctctaatgggcctgccaagggtgcgtcctaaccggcgtctgggtcatagcccacgagtgcggccaccacgccttcagcgaccaccagtggctggacgacgccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13947 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13948 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccaggggctggacgacgccgtgggcctcggcttccactcctacctcctcgtcccttacttctcctggaacagccatcgacgccaccattccaacaccggatccctcgagagagacgaagtgtttgtccccaagaagaagtcagacatcaagtggtacggcaagtacctcaacaacactttgggacgcaccgtgaggttatcggttcagttcactcgcggctggcctttgtacttag

SEQ ID NO: 13949 - DNA, 340 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcccaccattccaacaccggatccctcgatagggacgaagtgttcgtccccaagaagaaatccgacatcaagtggtacggcaagtacctcaacaacccgctaggacgcacggtgatgctaaccgtccagttcaagctcggctggcctttgtacttag

SEQ ID NO: 13950 - DNA, 354 bp, Artificial
  Mutation in BnaA.FAD2.a introduced by TALE nuclease pair BnFAD2_T02
cctctcctcctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtatcgacgccaccattccaacactggctccctcgagagagacgaagtgtttgtccccaagaagaaatccgacatcaagtggtacggaaagtacctcaacaacccgcgaggacgcacggtgatgctaaccgtccagttcacgctcggctggcctttgtacttag

SEQ ID NO: 13951 - DNA, 362 bp, Artificial
  Mutation in BnaA.FAD2.a introduced by TALE nuclease pair BnFAD2_T02
cctctcctccctcaccctctcccctacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaaagtacagtcatcgacgccaccattccaaccctgcctccctcgggagaaacgaagtgtttgtccccaagaagaaggccggcaacaagtggtccggcaaatacctcaacaaccctttggggcccaccggggtgttaaccgtccagttcactcgcggctggcctttgtacttag

SEQ ID NO: 13952 - DNA, 359 bp, Artificial
  Mutation in BnaA.FAD2.a introduced by TALE nuclease pair BnFAD2_T02
cctctcctcctcaccctctctcctacttcgcctggcctctctactgggcctgccaagggtgcgtcctaaccggcgtctgggtcatcgcccacgagtgcggccaccacgccttcagcgactaccagtggctggacgacaccgtcggcctcatcttccactccttcctcctcgtcccttacttctcctggaagtaagtcatcgacgccaccattccaaccctggctccctcgagagagacgaagtgtttgtccccaagcagcagccacacatcaagtggtacggcagctacctcagcaaccctttgggacgccccgtgaggttaacggttcaattgactctcggatggcctttgtacttag

SEQ ID NO: 13953 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13954 - DNA, 332 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 13955 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgctgccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggaagcaccgtgatgttaacggttcagttcactctaggctggcctttgtacttag

SEQ ID NO: 13956 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctcacccgcgtctgggtcatcgcccacgagtgcggccaccacgccttcagcgactaccagtggctggacgacaccgtcggcctcatcttccactccttcctcctcgtcccttacttctcctggaagagtcatcgacgccaccattccaacactggctccctcgggagagacgaagtgtttgtccccaagaagaagtcagacatcaagaggtacggcaagtaccacaccaaccctttgggacgcgccgtgatgttaacggttcagttcactctcggctggccgttgtacttag

SEQ ID NO: 13957 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 13958 - DNA, 437 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaccgtctccagcgcctgttgccggtgccgtgccaggcccacggcttgaccccggagcaggtggtggccatcgccatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13959 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaagtccgacatccagtggtacggcaagtacctcaacaaccctttgggacgcaccgtgatgttaacggttcagttcactctctgctggcctttgtacttag

SEQ ID NO: 13960 - DNA, 351 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgcatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13961 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaattatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13962 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacaggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13963 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctactcgtcccttacttctcctggatgtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 13964 - DNA, 359 bp, Artificial
  Mutation in BnaA.FAD2.a introduced by TALE nuclease pair BnFAD2_T02
cctctcctccctcaccctctctcctacttcgcctggaccctccactgggcctgccagggctgcgtcctaaccggcgtctgggtcatagcccacgagtgcggccacctcgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtaccgcaacaacccgttgggacgcaccgtgatgttaacggttcagttcactctcggctggcctttgtacttag

SEQ ID NO: 13965 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtactcatcgacgccaccattccaacactggctccctcgagagagacgaagtgtttgtccccaagaagaagtcagacatcaagtggtacggcaagtacctcaacatcccttcgggacgcaccgtgatgttaacggtacagttcactctcggctggcctttgtgcttag

SEQ ID NO: 13966 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctaggtcatagcccacgagtgcggccaccacgccttcagcgactaccagtggctggacgacaccgtcggcctcatcttccactccttcctcctcgtcccttacttctcctggatcgacgccaccattccaacactggctccctcgagagagacgaagtgtttgtccccaagaagaagtcagacagcaagtggtacggcaagtacctcaacaaccctttgggacgcaccgtgatgttaacggttcagttcgctctcggctggccctttgtacttag

SEQ ID NO: 13967 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaagtatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13968 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgaatgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 13969 - DNA, 356 bp, Artificial
  Mutation in BnaA.FAD2.a introduced by TALE nuclease pair BnFAD2_T02
cctctcctccctcaccctctctcctacttcgcctggtctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 13970 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccaaggctgcgccctaacgggcctctgggtcatcgcccacgaatgcggccaccacgccttcagcgaccaccagtggctggacgacgccgtgggcctcgtcttccactccttcctcctcgtcccttacttctcctcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13971 - DNA, 358 bp, Artificial
  Mutation in BnaA.FAD2.a introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgcctgcagcgaccaccagtggctggacgacgccgtgggcctcgtcttccactccttcctcctcgtcccttacttctcctggaaaagtcatcgacgccaccattccaacactggctccctcgagagagacgaagtgtttgtccccaagaagaagtcagacatcaagtggtacggcaagtacctcaacatccctttgggacgcaccgtgatgttaacggttcagttcactctcggctggccttagtacttag

SEQ ID NO: 13972 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaaggacctcagcgtcccttggggacgcgccgtggtgttaacggttcagttcgctctctcctggcctttgtacttag

SEQ ID NO: 13973 - DNA, 357 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 13974 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13975 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctcagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 13976 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcatttgtacttag

SEQ ID NO: 13977 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13978 - DNA, 358 bp, Artificial
  Mutation in BnaA.FAD2.a introduced by TALE nuclease pair BnFAD2_T02
cctctcctccctcaccctctatcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13979 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctatgggtcatcgcccacgaatgcggccaccacgccttcagcgaccaccagtggctggacgacgccgtgggcctcgtcttccactccttcctcctcgtcccttacttctcctggaacagtcatcgacgccaccattccaacactggctccctcgagagagacgaagtgtttgtccccaagaagaagtcagacatcaagtggtacggcaagtacctcagcaacccttgggtacgcaccgggatgttaacggttcatttcactctcggctggcctttgtacttag

SEQ ID NO: 13980 - DNA, 353 bp, Artificial
  Mutation in BnaA.FAD2.a introduced by TALE nuclease pair BnFAD2_T02
cctctcctccctcaccctctttcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13981 - DNA, 358 bp, Artificial
  Mutation in BnaA.FAD2.a introduced by TALE nuclease pair BnFAD2_T02
cctctcctccctcaccctctctcctacttcgcctggcctctctcctgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcaaacatcaagtggtacggcgagtacctcaacaaccctttgggacgcaccgtgatgttaacggttcagttctctctcggctggcctttatacttag

SEQ ID NO: 13982 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 13983 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 13984 - DNA, 273 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccatcgacgccaccattccaacaccggatccctcgagagggatgaagtgttcgtccccaagaagaagtcagacatcaagtggtacagcaagtacctcaacaaccctttgggacgcaccgtgatgttaacggttcagttcactctcggctggcctttgtacttag

SEQ ID NO: 13985 - DNA, 391 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcatcttccactccttccaccaccagcaatattggtggcaagcaggcgctggagacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 13986 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctgtacagtcatcgacgccaccattccaacactggctccctcgagagagacgaagtgtttgtccccaagaagaagtcagacatcaagtggtacggcaagtacctcaacaaccctttgggacgcaccgtggtgttaacggttcagttcactctcggctggcctttgtacttag

SEQ ID NO: 13987 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 13988 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaactcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 13989 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaattcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13990 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccagcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 13991 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctggttcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13992 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13993 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13994 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttcctctccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13995 - DNA, 330 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 13996 - DNA, 357 bp, Artificial
  Mutation in BnaA.FAD2.a introduced by TALE nuclease pair BnFAD2_T02
cctctcctccctcaccctctctcctacttcgcctggcctctctactggacctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 13997 - DNA, 347 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 13998 - DNA, 453 bp, Artificial
  Mutation in BnaA.FAD2.a introduced by TALE nuclease pair BnFAD2_T02
cctctcctccctcaccctctctcctacttcgcctggcctctctactgggcctgccggggctgcgtcctaaccggcgtctgggtcatagcccacgagtgcggccaccacgccttcagcgactaccagtggcttgacgacaccgtcggtctcatcttccactccttcctcctcgtcccttacttctcctggaaagcgcaacggctgttgccggtgctgtgccaggcccacggcttgaccccccagcaggtggtggccatcgccagcaatggcggtggcaagcaggcgctggtcatcgacgccaccattccaacactggctccctcgagagagacgaagtgtttgtccccaagaagaagtcagacatcaagtggtacggcaagtacctcaacaaccctgtgggacgcaccgggatgttaacggttcagttcactctcggcgggtctttgtacttag

SEQ ID NO: 13999 - DNA, 357 bp, Artificial
  Mutation in BnaA.FAD2.a introduced by TALE nuclease pair BnFAD2_T02
cctctcctccctcaccctctctactacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacatccctttgggacgcaccgtgatgttaacggttcagttcactctcggctggcctttgtacttag

SEQ ID NO: 14000 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcgtcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14001 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgtccacgaatgcggccaccacgccttcagcgaccaccagtggctggacgacgccgtgggcctcgtcttccactccttcctcctcgtcccttacttctcctggatgccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14002 - DNA, 336 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtgggcctcgtcttccactccttcctcctcgtcatcgacgccaccattccaacactggctccctcgagagagacgaagtgtttgtccccaagaagaagtcagacatcaagtggtacggcaagtacctcaacaaccctttggcacgcaccgtgatgttaacggttcagttcactttcggctggcctttgtacttag

SEQ ID NO: 14003 - DNA, 294 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgactccgtcggcatcatcttccactccttcctccttgtcaagtgtttgtccccaagacgaagtcagacatcaagtggtacggcaagttcctcaacaaccctttggaacgcaccgtgatgttaacggttcatgtcactcgtgggtggcctttatacttag

SEQ ID NO: 14004 - DNA, 356 bp, Artificial
  Mutation in BnaA.FAD2.a introduced by TALE nuclease pair BnFAD2_T02
cctctcctccctcaccctctatcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14005 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaatgtcatcgacgccacgattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14006 - DNA, 378 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatatggcggcaagcaggcgatggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14007 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14008 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctgggcgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggccctggtacttag

SEQ ID NO: 14009 - DNA, 413 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgaccaccagtggctggacgacgccgtcggcctcatcttccactccttcctcctcgtcccttacttctcctggaagtggccatcgccagccactgactcgctgcgctcggtcgttcggctgcggcgagcggtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14010 - DNA, 356 bp, Artificial
  Mutation in BnaA.FAD2.a introduced by TALE nuclease pair BnFAD2_T02
cctctcctccctcaccctctctcctacttcgcctggcctctctactcggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 14011 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttactcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14012 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgtgtcctaaccggcgtctgggtcatagcccacgagtgcggccaccacgccttcagcgactaccagtggctggacgacaccgtcggcctcgtcttccactccttcctcctcgtcccttacttctcctggacgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14013 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggtgcaggtcactctcggctggcctttgtacttag

SEQ ID NO: 14014 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggcttgacgacaccgtcggtctcatcttccactccttcctcctcgtcccttacttctcctggaagtacaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14015 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14016 - DNA, 390 bp, Artificial
  Mutation in BnaA.FAD2.a introduced by TALE nuclease pair BnFAD2_T02
cctctcctcctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtgtaggtcgttcgctccaagctgggctgtgtgcacgaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14017 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctgtgggacgcgccgtgatgttaacggttcagttcactctcggctggcctttgtacttag

SEQ ID NO: 14018 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctagagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14019 - DNA, 355 bp, Artificial
  Mutation in BnaA.FAD2.a introduced by TALE nuclease pair BnFAD2_T02
cctctcctccctcaccctctctcctacttcgcctggcccctctactcggcctgccagggccgcgtcctcaccagcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaggtagcccaacaagccttatggacgcaccgtgaggttaccccttccgctccctctcggctggcctttgtacttag

SEQ ID NO: 14020 - DNA, 417 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtcggcctcatcttccactccttcctcctcgtcccttacttctcctggaattgttgccggtgctgtgccaggcccacggcttgaccccggagcaggtggtggccatcgccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 14021 - DNA, 318 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaagtagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14022 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 14023 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggatcgacgccaccattccaatactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14024 - DNA, 353 bp, Artificial
  Mutation in BnaA.FAD2.a introduced by TALE nuclease pair BnFAD2_T02
cctctcctccctcaccctctctactacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14025 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgttcgtccccaagaagaagtcagacatcaagtggtacggcaagtacctcaacaaccctttgggacgcaccgtgatgttacggttcagttcactctcggctggcctttgtacttag

SEQ ID NO: 14026 - DNA, 358 bp, Artificial
  Mutation in BnaA.FAD2.a introduced by TALE nuclease pair BnFAD2_T02
cctctcctccctcaccctctatcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacaccggatccctcgagagggatgaagtgttcgtccccaagaagaaatccgacatcaagtggtacggaaagtacctcaacgacccgctaggacgcacggtgatgctaaccggccaggtcacgctcggctggcctatgtacttag

SEQ ID NO: 14027 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaagttggttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14028 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14029 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 14030 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctgaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 14031 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14032 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacatcaacaacccgttgggacgcaccgtgatgttaacggttcagttcactctcggctggcctttgtacttag

SEQ ID NO: 14033 - DNA, 332 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 14034 - DNA, 358 bp, Artificial
  Mutation in BnaA.FAD2.a introduced by TALE nuclease pair BnFAD2_T02
cctctcctccctcaccctctaccttacctcgcctggcccctatactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14035 - DNA, 347 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttatccatgacgccaccattccaacaccggatccctcgatagggacgaagtgttcgtccccaagaagaaatccgacatcaagtggtacggcaagtacctcaacaacccgctaggacgcacggtgatgctaaccgtccagttcaagctcggctggcctttgtacttag

SEQ ID NO: 14036 - DNA, 350 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttactaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14037 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14038 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 14039 - DNA, 318 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagagagacgaagtgtttgtccccaagaagaagtcagacatcaagtggtacggcaagtacctcagcaacccgttgggacgcaccgtgatgttaacggttcagttcactctcggctggcctttgtacttag

SEQ ID NO: 14040 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtatcatcgacgccaccattccaacaccggatccctcgagagggatgaagtgttcgtccccaagaagaaatccgacatcaagtggtacggaaagtacctcaacaaccctttgggacgcaccgtgaggttaacggttcagttcactctcgcctggccttagtacttag

SEQ ID NO: 14041 - DNA, 351 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14042 - DNA, 346 bp, Artificial
  Mutation in BnaA.FAD2.a introduced by TALE nuclease pair BnFAD2_T02
cctctcctccctcaccctctcccttacttcgcctggcctctctactgggcctgccaaggctgcgtcctaaccggcgtctgggtcatagcccacgagtgcggccaccacgccttcagcgactaccagtggcttgacgacaccgtcggcctcctcttccactccttcctcctcgtcccgtacagtcatcgacgccaccatcccaacaccggatccctcgagagggatgaagtgttcgtccccaagaagaagtccgacatcaagtggtacggaaagtacctcaacaaccctctgggacgcactgtgatgctaacggtccagttcactctcggctggcctttgtacttag

SEQ ID NO: 14043 - DNA, 291 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggaagactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14044 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcatcgtgatgttaacggttcagttcactctcggctggcctttgtacttag

SEQ ID NO: 14045 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtacccaacaaccctttgggacgcaccgtgatgttaacggttcagttcactctcggctggcctttgtacttag

SEQ ID NO: 14046 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggattcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14047 - DNA, 340 bp, Artificial
  Mutation in BnaA.FAD2.a introduced by TALE nuclease pair BnFAD2_T02
cctctgctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcagtcatcgacgccaccattccaacactggctccctcgagagagacgaagtgtttgtccccaagaagaagtcagacatcaagtggtacggcaagtacctcaacaaccctttgggacgcacggtgaggctaaccgtccaggtcacgctcggctggcctgtgtacttag

SEQ ID NO: 14048 - DNA, 356 bp, Artificial
  Mutation in BnaA.FAD2.a introduced by TALE nuclease pair BnFAD2_T02
cctctcctccctcaccctctaccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaaatccgacatcaagtggtacggcaagtacctcaacaaccctttgggacgcaccgtgatgttaacggttcagttcactctcggctggcctttgtacttag

SEQ ID NO: 14049 - DNA, 419 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacattccgtggcgttatccagctaagcgcgaactgcaatttggagaatggcagcgcaatgacacatcgacgccaccattccaacactggctccctcgagagagacgtggtgtttgtcccctagaagaagtcagacatcaagtggtacggcaagtacctcaccaaccctttgggacgcaccgtgatgttaacggttcagttcactctcggctggcctttgtacttag

SEQ ID NO: 14050 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttccccctcgtcccttacttctcctgtacagtcatcgacgccaccattccaacactggctccctcgagagagacgaagtgtttctccccaagaagaagtcagacatcaagtggtacggcaagtacctcaacatgcctttgggacgcaccgtgatgttaacggttcagttcacgctcggctggcctttgtgcttag

SEQ ID NO: 14051 - DNA, 343 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttgccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14052 - DNA, 318 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcacacgagtgcggccaccacgccttcagcgactaccagtggctggacgacaccgtcggcctcatcttccactccttcctcctcgtcccttacttctcctggagagagacgaagtgtttgtccccaagaagaagtcagacatcaagtggtacggcaagtacctcaacaaccccttgggacgcaccgtgatgttaacggttcagttcactctcggctggcctttgtacttag

SEQ ID NO: 14053 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14054 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcatcgacgccaccattccaactctggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14055 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccttgggacgcaccgtgatgttaacggttcagttcactctcggctggcctttgtacttag

SEQ ID NO: 14056 - DNA, 354 bp, Artificial
  Mutation in BnaA.FAD2.a introduced by TALE nuclease pair BnFAD2_T02
cctctcctccctcaccctctcccctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14057 - DNA, 346 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcgatctcatcttccactccttcctcctcgtcccttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14058 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14059 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14060 - DNA, 358 bp, Artificial
  Mutation in BnaA.FAD2.a introduced by TALE nuclease pair BnFAD2_T02
cctctcctccctcaccctctctcctacttcgcctggcctctctactgggactgccaagcctgcgccctaacgggcctctgggtcatcgcccacgaatgcggccaccacgccttcagcgaccaccagtggctggacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtacggcaagtaccgcaacaaccgtttgggacgcaccgtgatcttaacggttcagttcactctcggctggcctttgtacttag

SEQ ID NO: 14061 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtttcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 14062 - DNA, 431 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacattgctggcgatggccaccacctgctggggggtcaagccgtgggcctggcacagcaccggcaacagccgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14063 - DNA, 330 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgtggccaccacgccttcagcgaccaccagtggctggacggcgccgtgggcctcgtcttccactccttcctcctcgtcgccaccattccaacactggctccctcgagagagacgaagtgtttgtccccaagaagaagtcacacatcaagtgttacggcaagtacctcaacatccctttgggacgccccgtgattttaacgtttcaattcactctcggccggcctttgtacctag

SEQ ID NO: 14064 - DNA, 358 bp, Artificial
  Mutation in BnaA.FAD2.a introduced by TALE nuclease pair BnFAD2_T02
cctctgctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctgtgtacttag

SEQ ID NO: 14065 - DNA, 356 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14066 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaactggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14067 - DNA, 423 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacggcttgaccccggagcaggtggtggccatcgccagccacgatggcggcaagcaggcgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccctttgtacttag

SEQ ID NO: 14068 - DNA, 355 bp, Artificial
  Mutation in BnaA.FAD2.a introduced by TALE nuclease pair BnFAD2_T02
ctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14069 - DNA, 346 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggagcaggcaatccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 14070 - DNA, 356 bp, Artificial
  Mutation in BnaA.FAD2.a introduced by TALE nuclease pair BnFAD2_T02
cctctgctccctcaccctctctcctacttcgcctggcctctctcatgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggacgtcatcgacgccaccattccaacactggctccctcgagagagacgaagtgtttgtccccaagaagaagtcagacaccaagtggtacggcaagtacctcaacaaccctgtgggacgcaccgggatgttaacggttcagttcactctcgcctggcctgagtacttag

SEQ ID NO: 14071 - DNA, 273 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacaaatgcggccaccacgccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14072 - DNA, 352 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctccagtcatcgacgccaccattccaacactggctccctcgagagagacgaagtgtttgtccccaagaagaagtcagacatcaagtggtacggcaagtacctcaacaaccctttgggacgcaccgtgatgttaacgtttcagttcactctcggctggcctttgtacttag

SEQ ID NO: 14073 - DNA, 384 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctgcaatggcggtggcaagcaggcgctggagacggtcatcgacgccaccattccaacgctggctccctcgagagagacgaagtgtttgtccccaagaagaagtcagacatcaagtggtacggcaagtacctcaacaaccctttgggacgcaccgtgatgttaacggttcatttcactctcggctggcctttgtacttag

SEQ ID NO: 14074 - DNA, 357 bp, Artificial
  Mutation in BnaA.FAD2.a introduced by TALE nuclease pair BnFAD2_T02
cctctcctccctcaccctctcccttacctcgcctggcccctctactaggcctgccaaggctgcgtcctaacgggcctctgggtcatcgcccacgaatgcggccaccacgccttcagcgaccaccagtggctggacgacgccgtgggcctcgtcttccactccttcctcctcgtcccatacttctcctggaaagccatcgacgccaccattccaacactggctccctcgagagagacgaagtgtttgtccccaagcagaagccagacatcaagtggtacggcaagtacctcaaccaccctttgggacgccccgtgatgttaacggttcagttcactctcggctggccttagtacttac

SEQ ID NO: 14075 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaactcatcgacgccaccattccaacactggctccctcgagagagacgaagtgtttgtccccaagaagaagtcagacatcaagtggtacggcaagtacctcaacaaccctttgggacgcaccgtgatgttaacggttcggttcactctcggctggcctttgtacttag

SEQ ID NO: 14076 - DNA, 356 bp, Artificial
  Mutation in BnaA.FAD2.a introduced by TALE nuclease pair BnFAD2_T02
cctctcctccctcaccctctaccctacttcgcctggcctctctactgggcctgccagggctgcgtcctaaccggcgtctgggtcatagcccacgagtgcggctaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcaaacaacaagtggtacggcaagtacctcaacaaacctgtggaacgcccagtgatgttaacgtttcatgtcactcgcgggtggcctttatacttag

SEQ ID NO: 14077 - DNA, 353 bp, Artificial
  Mutation in BnaA.FAD2.a introduced by TALE nuclease pair BnFAD2_T02
cctcttctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctgatcatcgacgccaccattccaacactggctccctcgagagagacgaagtgtttgtccccaagaagaagtcagacatcaagtggtacggcaagtacctcaacaaccctttgggccgcaccgtgatgttaacggttcagttcactctcggctggccttagtacttag

SEQ ID NO: 14078 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 14079 - DNA, 358 bp, Artificial
  Mutation in BnaA.FAD2.a introduced by TALE nuclease pair BnFAD2_T02
cctctcctccctcaccctctatcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 14080 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcggttctctctcggctggcatttgtacttag

SEQ ID NO: 14081 - DNA, 346 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggagccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14082 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacgggtcagttcactctcggctggcctttgtacttag

SEQ ID NO: 14083 - DNA, 291 bp, Artificial
  Mutation in BnaA.FAD2.a introduced by TALE nuclease pair BnFAD2_T02
cctctcctccctcaccctctctcctacttcgcctggcctctctactgggcctgccaaggttgcgtcctaaccggcgtctgggtcatagcccacgagtgcggccaccacgccttcagcgactaccagtggctggacgacaccattccaacactggctccctcgagagagacgaagtgtttgtccccaagaagaagtcagacatcaagtggtacggcaagtacctcaacaaccctctgggacgctccgtgatgttaacggttcagttcactctcggctggcctttgtacttag

SEQ ID NO: 14084 - DNA, 385 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcaagccgtgggcctggcacagcaccggcaacagccgctggaccgtctccagctgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14085 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14086 - DNA, 400 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaagtaaccgcctctccccgcgcgttggcacgacaggtttcccgacagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggcgggcctttgtacttag

SEQ ID NO: 14087 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagcagtcatcgacgccaccattccaacactggctccctcgagagagacgaagtgtttgtccccaagaagaagtcggacatcaagtggtacggcaagtacctcaacaaccctttgggacgcaccgtgatgttaacggttcagttcactctcggctggcctttgtacttag

SEQ ID NO: 14088 - DNA, 355 bp, Artificial
  Mutation in BnaA.FAD2.a introduced by TALE nuclease pair BnFAD2_T02
cctctcctccctcaccctctctcctacttcgcctggcctctctactgagcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 14089 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcgccgggatgttatcggtgaatgtcattcgtggctggcctgaatacgtag

SEQ ID NO: 14090 - DNA, 356 bp, Artificial
  Mutation in BnaA.FAD2.a introduced by TALE nuclease pair BnFAD2_T02
cctctcctccctcaccctctatcctacttcgcctggcctctctactgggcctgccagggctgcgtcctaaccggcgtctgggtcatagcccacgagtgcggccaccacgccctcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14091 - DNA, 356 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14092 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14093 - DNA, 439 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggtctcatcttccactccttcctcctcgtcccttacttctcctggaaagtccagcgcctgcttgccaccgccattgctggcgatggccaccacctgctggggggtcaagccgtgggcctggcacagcaccggcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14094 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtcggcctcatcttccactccttcctcctcgtcccttacttctcctggaagtcatcgacgccaccattccaacactggctccctcgagagagacgaagtgtttgtccccaagaagaaatccgacatcaagtggtacggcaagtacctcaacaaccctttgggacgcaccgtgatgttaacggttcagttcactctcggctggcctttgtacttag

SEQ ID NO: 14095 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 14096 - DNA, 355 bp, Artificial
  Mutation in BnaA.FAD2.a introduced by TALE nuclease pair BnFAD2_T02
cctctcctacctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcgccgtgaggttaacggttcaggtcactctcggcgggcctttgtacgtag

SEQ ID NO: 14097 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggatacagtcatcgacgccaccattccaacactggctccctcgagagagacgaagtgtttgtccccaagaagaagtcagacatcaagtggtacggcaagtacctcagcaaccctttgggacgcaccgtgatgttaacggttcagttcactctcggctggcctttgtacttag

SEQ ID NO: 14098 - DNA, 346 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacagtcatcgacgccaccattccaacactggctccctcgagagagacgaagtgtttgtccccaagaagaagtcagacatcaagtggtacggcaagtacctcaacaaccctgtgggacgcaccgtgttgttaacggttcagttcactcccggctggcctttgtacttag

SEQ ID NO: 14099 - DNA, 421 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggcttgacgacaccgtcggtctcctcttccactccttcctcctcgtcccttacttctcctggaagtaaggtttcatttagcgcctcaaatagatcctgttcaggaaccggatcaaagagttcctccgcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14100 - DNA, 358 bp, Artificial
  Mutation in BnaA.FAD2.a introduced by TALE nuclease pair BnFAD2_T02
cctctcctccctcaccctctctcttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14101 - DNA, 356 bp, Artificial
  Mutation in BnaA.FAD2.a introduced by TALE nuclease pair BnFAD2_T02
cctctactccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctagaagtcatcgacgccaccattccaacactggctccctcgagagagacgaagtgtttgtccccaagaagaagtcagacatcaagtggtacggcaagtacctcaacaaccctttgggacgcaccgggatgttaacggttcatgtcactcttggctggcctgagtacttag

SEQ ID NO: 14102 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14103 - DNA, 357 bp, Artificial
  Mutation in BnaA.FAD2.a introduced by TALE nuclease pair BnFAD2_T02
cctcttctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaacccgctaggacgcagggtgaggctatcagtccagttcacgctcggctggccttagtacttag

SEQ ID NO: 14104 - DNA, 409 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggagcaacagccgctggaccgtctccagcgcctgcttgccgccatcgtggctggcgagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14105 - DNA, 323 bp, Artificial
  Mutation in BnaA.FAD2.a introduced by TALE nuclease pair BnFAD2_T02
cctctcctccctcaccctctcccttacctcgcctgccccctctactggtcttcccaagtctgcgccctaacgggcctctgggtcatcgcccacgagtgcggccaccacgccttcagcgactaccagtggctggacgacaccgtcggcctcatcttccactccttcctcctcgtcccttacttctcctggaagtaccgctcgccgcagccgaacgaccgagaagaagtcagacatcaagtggtacggcaagtacctcaacaccccttagggacgcaccgggatgttaacggttcagttcactctcggctggcctttgtacttag

SEQ ID NO: 14106 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgggatgttaacggttcaggtcactcgcggctggcctgtgtacttag

SEQ ID NO: 14107 - DNA, 434 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatggcggcaagcaggcgctggagacggtccagcggctgttgccggtgctgtgccaggcccacggcttgaccccccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14108 - DNA, 357 bp, Artificial
  Mutation in BnaA.FAD2.a introduced by TALE nuclease pair BnFAD2_T02
cctctcctccctcaccctctctcctacttcgcccggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14109 - DNA, 356 bp, Artificial
  Mutation in BnaA.FAD2.a introduced by TALE nuclease pair BnFAD2_T02
cctctcctccctcaccctctcccttacctcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14110 - DNA, 388 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagccttctgcttagtttgatgcctggcagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 14111 - DNA, 346 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccgtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14112 - DNA, 332 bp, Artificial
  Mutation in BnaA.FAD2.a introduced by TALE nuclease pair BnFAD2_T02
cctctcctccctcaccctctaccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14113 - DNA, 350 bp, Artificial
  Mutation in BnaA.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggctggactacaccgtcggcctcatcttccactccttcctcctcgtcccttactaacagtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 14114 - DNA, 364 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtattacagtcatcgacgccaccattccaacactggctccctcgagagagacgaagtgtttgtccccaagaagaagtcagacatcaagtggtacggcaagtacctcaacaaccctttgggacgcaccgtgattttaacggttcagttcactctcggctggcctgtgtacttag

SEQ ID NO: 14115 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctccatcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 14116 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgtcaacggttcagttcaatctcggctggcctttgtacttag

SEQ ID NO: 14117 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgactaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctgtgggacgcaccgtgatgttaacggttcggttcactctcggctggcctttgtgcttag

SEQ ID NO: 14118 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtcggggtcatagcccacgagtgcggccaccacgccttcagcgactaccagtggctggacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14119 - DNA, 346 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccgtacagtcatcgacgccaccattccaacactggctccctcgagagagacgaagtgtttgtccccaagaagaagtcacacatcaagtgttacggcaagtacctcaacatccctttgggacgcaccgtgatgtaaacggttcagttccctctaggatggcctttgtgcttag

SEQ ID NO: 14120 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccatcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14121 - DNA, 423 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgccccttactttccagcgcctgcttgccgccatcgtggctggcgatggccaccacctgctggggggtcaagccgtgggcctggcacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14122 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 14123 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacgtcatcgacgccaccattccaacaccggatccctcgagagggatgaagtgttcgtccccaagaagaagtcagacatcaagtggtacggcaagtacctcaacaaccctttgggacgcaccgtgaggttaacggttcagttcactctcggctggcctttgtacttag

SEQ ID NO: 14124 - DNA, 355 bp, Artificial
  Mutation in BnaA.FAD2.a introduced by TALE nuclease pair BnFAD2_T02
cctctcctccctcaccctctaccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14125 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 14126 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14127 - DNA, 382 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagactgagcctttcgttttatttgatgcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttg

SEQ ID NO: 14128 - DNA, 394 bp, Artificial
  Mutation in BnaA.FAD2.a introduced by TALE nuclease pair BnFAD2_T02
cctctcctccctcaccctctctcctacctcgcctggcctctctactgggcctgccaagtccgcgtcctaaccggcgtctgggtcatagcccacgagtgcggccaccacgccttcagcgactaccagtggctggacgacaccgtcggcctcagcttccactccttcctcctcgtcccttacttctcctggaagtaccgctcgccatgcatgcactgcctccactgcggtagtcatcgacgccaccattccaacactggctccctcgagagagacgaagtgtttgtacccaagaagaagtcagacatcaagtggtacggcaagtacctgaacgacccagtgggacatagcgtaatgttaacggtccatttcactctcggctggcctttgtacttag

SEQ ID NO: 14129 - DNA, 356 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14130 - DNA, 312 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgactaccagtggctggacgacaccgtcggcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14131 - DNA, 348 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttcttcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 14132 - DNA, 352 bp, Artificial
  Mutation in BnaA.FAD2.a introduced by TALE nuclease pair BnFAD2_T02
cctctcctccctcaccctctcccttacctcgcctggcccctctactgagcctgccaaggctgcgtcctaacgggcctctgggtcctcgcccacgaatgcggccaccacgccttcagcgaccaccagtggctggacgacgccgtcggtctcatcttccactccttcctcctcgtcccttacttctccagtcatcgacgccaccattccaacactggctccctcgagagagacgaagtgtttgtccccaagaagaagtcagacatcaagtggtacggcaagtacctcaacaaccctttgggacgcaccgtgatgttaacgtttcagttcactctcggctggcctttgtacttag

SEQ ID NO: 14133 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcatttgtacttag

SEQ ID NO: 14134 - DNA, 318 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagagagacgaagtgtttgtccccaagaagaagtcagacatcaagtggtacggcaagtacctcaacaaccctttgggacgcaccgtgatgttaacggtgcagttcactctcggctggcctgtgtacttag

SEQ ID NO: 14135 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcgggtggcctttgtacttag

SEQ ID NO: 14136 - DNA, 356 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14137 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcctctgggtcatcgcccacgaatgcggccaccacgccttcagcgaccaccagtggctggacgacgccgtgggcctcgtcttccactccttcctcctcgtcccttacttctcctacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 14138 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14139 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 14140 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgtgggacgcaccgtgagtttaacggttcagttcactctcggctggcctttgtacttag

SEQ ID NO: 14141 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 14142 - DNA, 329 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggctggacgacaccgtcggcctcatcttccactaccagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 14143 - DNA, 412 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaattaggccaccacttcaagaactctgtagcaccgcctacatacctcgctctgctacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 14144 - DNA, 357 bp, Artificial
  Mutation in BnaA.FAD2.a introduced by TALE nuclease pair BnFAD2_T02
cctctcatccctcaccctctctcctacttcgcctgccctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtccgtcaagtcccccaccacccctgtgggacgcaccgggctgtcaaccgttccgctccctctcggctggcctttgtacttag

SEQ ID NO: 14145 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtaggcctcatcttccactccttcctcctcgtcccttacttctcctggaagttatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14146 - DNA, 413 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtggccatcgccagccactgactcgctgcgctcggtcgttcggctgcggcgagcggtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14147 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggttggacgacaccgtcggcctcatcttccactccttcctcctcgtcccttacttctcctggaagtcatcgacgccaccattccaacactggctccctcgagagagacgaagtgttcgtccccaagaagaagtcagacatcaagtggtacggcaagtacctcaacacccctttgggacgcaccgtgatgttaacggttccgttctctctcggctggcctttgtccttag

SEQ ID NO: 14148 - DNA, 362 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctccgggaacaaacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctctgctggcctttgtacttag

SEQ ID NO: 14149 - DNA, 336 bp, Artificial
  Mutation in BnaA.FAD2.a introduced by TALE nuclease pair BnFAD2_T02
cctctcctccctcaccctctaccttacctcgcctggcctctctactgggcctgccagggctgcgtcctaaccggcgtctgggtcatagcccacgagtgcggccaccacgccttcagcgaccaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccatttgggacgcaccgttatgttaacggttcagttcactctcggctggcctttgtgcttag

SEQ ID NO: 14150 - DNA, 394 bp, Artificial
  Mutation in BnaA.FAD2.a introduced by TALE nuclease pair BnFAD2_T02
cctctcctccctcaccctctctcctacttcgtctggcctctctactgggcctgccaagggtgcgtcctaaccggcgtctgggtcatagcccacgagtgtggccaccacgccttcagcgactaccagtggctggacgacaccgtcggcctcatcttccactccttcctcctcgtcccttacttctcctggaagtaccgctcgccatgcatgcactgcctccactgcggtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14151 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 14152 - DNA, 346 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggcgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14153 - DNA, 370 bp, Artificial
  Mutation in BnaA.FAD2.a introduced by TALE nuclease pair BnFAD2_T02
cctctcctccctcaccctctctcctacttcgcctggcctctctactgagcctgccagggctgcgtcctaaccggcgtctgggtcatagcccacgagtgcggccaccacaccttcagcgactaccagtggctggacgacaccgtcggcctcatcttccactccttcctcctcgtcccttacttctcctggaagtaagaaaaatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14154 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtgcttag

SEQ ID NO: 14155 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacgccgtgggcctcgtcttccactccttcctcctcgtcccttacttctcctggaaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14156 - DNA, 402 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcaagccgtgggcctggcacagcaccggcaacagccgctggaccgtctcctacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 14157 - DNA, 387 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctgggcctggcacagcaccggcaacagccgctggacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 14158 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggtcatcgacgccaccattccaacactggctccctcgagagggatgaagtgttcgtccccaagaagaaatccgacatcaagtggtacggaaagtacctcaacaacccgctaggacgcacggtgattctaaccgtccagttcacgctcggctggcctttgtacttag

SEQ ID NO: 14159 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 14160 - DNA, 357 bp, Artificial
  Mutation in BnaA.FAD2.a introduced by TALE nuclease pair BnFAD2_T02
cctctcctccctcaccctctctcctacttcgcgtgccctctctactgggcctgccaagggtgcgtcctaacggcccgctgggtcatcgcccacgaatgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaagcctgttggacgcaccgggatgttaacggttcatttccctctcggctggcctttgtacttag

SEQ ID NO: 14161 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcttcctcgtcccttacttctcctggaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 14162 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaacagccatcgacgccaccattccaacactggctccctcgagagagacgaagtgtttgtccccaagaagaagtcagacatcaagtggtacggcaagtacctcaacaaccctttgggacgcaccgtgatgttatcggttcagttcactctcggctggcctttgtacttag

SEQ ID NO: 14163 - DNA, 352 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14164 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 14165 - DNA, 332 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14166 - DNA, 337 bp, Artificial
  Mutation in BnaA.FAD2.a introduced by TALE nuclease pair BnFAD2_T02
cctctcctccctcaccctctctcctacttcgcctggactctctactgggcctgccaagggtgcgtcctaaccggcgtctgggtcatagcccacgaatgcggccaccacgccttcagcgaccaccagtggctggacgacgccgtgggcctcgtcttccactccttcttccacagccatcgacgccaccattccaacaccggatccctcgagagggatgaagtgttcgtccccaagaagaagtcagacatcaagtggtacggcaagtacctcaacaaccctttgggacgcaccgtgatgttaacggtccagttcacgctcggctggcctttgtacttag

SEQ ID NO: 14167 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactag

SEQ ID NO: 14168 - DNA, 357 bp, Artificial
  Mutation in BnaA.FAD2.a introduced by TALE nuclease pair BnFAD2_T02
cctctcctccctcaccctctatcctacttcgcctggcctctctactgggcctgccaaggctgcgtcctaacgggcctctgggtcatcgcccacgaatgcggccaccacgccttcagcgaccaccagtggctggacgacgccgtcggcctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctttgggacgcaccgtgatgttaacggttcagttgactctcggctggcctttgtacttag

SEQ ID NO: 14169 - DNA, 443 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgcaatgcactgacgggtgccccgctcaacttgacccctctccagcgcctgcttgccgccatcgtggctggcgatggccaccaccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14170 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgagtttatcggttcagttctctctcggctggccttgttacttag

SEQ ID NO: 14171 - DNA, 391 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcatcttccactccttccaccaccagcaatattggtggcaagcaggcgctggagacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 14172 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccttttggacgcaccgtgatgttaacggttcagttcactctcggctggcctttgtacttag

SEQ ID NO: 14173 - DNA, 357 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14174 - DNA, 358 bp, Artificial
  Mutation in BnaA.FAD2.a introduced by TALE nuclease pair BnFAD2_T02
cctctgctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcctcttccactccttcctcctcgtcccttacttctcctggaagtgtcatcgacgccaccattccaacactggctccctcgagagagacgaagtgtttgtccccaagaagaagtcacacatccagtggtaccgcaagtacctcaacaaccctttgggacgcaccgtgatgttaacggttcagttcactctcgcctggccttagtacttat

SEQ ID NO: 14175 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14176 - DNA, 359 bp, Artificial
  Mutation in BnaA.FAD2.a introduced by TALE nuclease pair BnFAD2_T02
cctctgctccctcaccctctctcctacttcgcctggcctctctcctgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgggatgttaacgtttcatttcacttgcggctggcctgtgtacttag

SEQ ID NO: 14177 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctcagtcatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14178 - DNA, 357 bp, Artificial
  Mutation in BnaA.FAD2.a introduced by TALE nuclease pair BnFAD2_T02
cctctcctccctcaccctctaccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14179 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgccccgtgatgttaacggttcagttcactctcggctggcctttgtacttag

SEQ ID NO: 14180 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacaccggatccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 14181 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggaagtcatcgacgccaccattccaacactggctccctcgagagagacgaagtgtttgtccccaagaagaaggcagacatcaagtggtacgacaagtacctcaacaaccctttgggacgcaccgtgatgttaacggttcagttcactctcggctggccttagtacttag

SEQ ID NO: 14182 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccgtcagcgactaccagtggctggacgacaccgtcggcctcatcttccactccttcctcctcgtcccttacttctcctggaaatcgacgccaccattccaacactggctccctcgagagagacgaagtgtttgtccccacgaagaagtcagccatcaagtggtacggcaagtacctcaacaaccctttgggacgaaccttgatgttaacggttcatttcactctcggctggcctttgtactcag

SEQ ID NO: 14183 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctctagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14184 - DNA, 353 bp, Artificial
  Mutation in BnaA.FAD2.a introduced by TALE nuclease pair BnFAD2_T02
cctccctcaccctctctcctacttcgcctggcctctctactgggcctgccaagggtgcgtcctaaccggcgtctgggtcatagcccacgaatgcggccaccacgccttcagcgaccaccagtggctggacgacgccgtgggcctcgtcttccactccttcctcctcgtcccttacttctcctggaacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14185 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 14186 - DNA, 391 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcatcttccactccttccaccaccagcaatattggtggcaagcaggcgctggagacagccatcgacgccaccattccaacaccggatccctcgagagggatgaagtgttcgtccccaagaagaaatccgacatcaagtggtacggaaagtacctcaacaagccgctaggacgcgcggtggtggtaagggggcagttcacgctcggctggcctttgtacttag

SEQ ID NO: 14187 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 14188 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagggatgaagtgttcgtccccaagaagaaatccgacatcaagtggtacggaaagtacctcaacaacccgctaggacgcacggggatgctaaccgtccaggtcacgcgcggctggcctgtgtacttag

SEQ ID NO: 14189 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14190 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctggctcatatcccacgagtgccgctaccacgccatcagcgactaccagtggcttgacgacaccgtcggtctcatcttccactccttcctcctcgtaccttacttctcctggaagaacatcgacgccaccattccaacactggctccctcgagagagacgaagtgtttgtccccaagaagaagtcagacatcaagtggtacggcaagtacctcaacaacccttaggcacgcaccgtgatgttatcgggtcagttctctctcggctggaatttgtacctag

SEQ ID NO: 14191 - DNA, 332 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtcggcctcatcttccactccttcctcctcgtcccttacttctcctggaactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14192 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaaatccgacatcaagtggtacggcaagtacctcaacaaccctttgggacgcaccgtgatgttaacggttcagttcactctcggctggcctttgtacttag

SEQ ID NO: 14193 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14194 - DNA, 329 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactaccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 14195 - DNA, 351 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14196 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggaaagtacctcaacaacccgctaggacgcacggggatggtaaccgtccagttcacgctcggctggcctttatacttag

SEQ ID NO: 14197 - DNA, 389 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacagcaacgtcggttcgagatggcgctcgaagtcatcgacgccaccattccaacactggctccctcgagagagacgaagtgtttgtccccaagaagaaatccgacatcaagtggtacggaaagtacctcaacaacccgctaggacgcacggtgatgctaaccttccagttcacgctcggctggcctttgtacttag

SEQ ID NO: 14198 - DNA, 336 bp, Artificial
  Mutation in BnaA.FAD2.a introduced by TALE nuclease pair BnFAD2_T02
cctctcctccctcaccctctcccttacctcgcctggcccctctactgcgcctgccaaggctgcgtcctaacgggcctctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgagatgttaacggttcagttcactcgcgtgtggcatgtgtacttag

SEQ ID NO: 14199 - DNA, 416 bp, Artificial
  Mutation in BnaA.FAD2.a introduced by TALE nuclease pair BnFAD2_T02
cctctcctccctcaccctctctcctacttcgcctggcctccctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggacacaggccaacttctcaagattgcaaaacgtggcggcgtgaccgcagtggaggtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14200 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatatcgacgccaccattccaacactggctccctcgagagagacgaagtgtttgtccccaagaagaagtcagacatcaagtggtacggcaagtacctcaacaaccctttgggacgcaccgggatgtttacgcttcagttcactctcggctggcctttgtacttag

SEQ ID NO: 14201 - DNA, 339 bp, Artificial
  Mutation in BnaA.FAD2.a introduced by TALE nuclease pair BnFAD2_T02
cctctcctccctcaccctctcccttacctcggctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccaccatttcaacactggcttcctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14202 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 14203 - DNA, 467 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacactccttcctcctcctcccttacttctcttcgtaacgcgcttgctgcttggatgcccgaggcatagactgtaccccaaccagaccaggaacaagcacatcaaccccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14204 - DNA, 350 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgtgcctctggttcctcgcccacgaatgcggccaccacgccttcagcgaccaccagtggctggacgacgccgtgggcctcgtcttccactccttcctcctcgtcccttacttctagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 14205 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggagtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggtttgtacttag

SEQ ID NO: 14206 - DNA, 319 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 14207 - DNA, 356 bp, Artificial
  Mutation in BnaA.FAD2.a introduced by TALE nuclease pair BnFAD2_T02
cctctcctccctcaccctctatcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggccttggtacttag

SEQ ID NO: 14208 - DNA, 421 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagcaggtggtggccatcgccagcaatggcggtggcaagcaggcgctggggacggtccagcggctgttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14209 - DNA, 357 bp, Artificial
  Mutation in BnaA.FAD2.a introduced by TALE nuclease pair BnFAD2_T02
cctctcctccctcaccctctaccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgtcctttgtacttag

SEQ ID NO: 14210 - DNA, 355 bp, Artificial
  Mutation in BnaA.FAD2.a introduced by TALE nuclease pair BnFAD2_T02
cctctgctccctcaccctctcccttacctcgcctggcccctctactgggcatgccaaggatgcgtcctaacgggcctctgggtcatagcccacgagtgcggccaccacgccttcagcgactaccagtggctggacgacaccgtcggcctcatcttccactccttcctcctcgtcccttacttctcctggaagcatcgacgccaccattccaacactggctccctcgagagagacgaagtgtttgtccccaagaagaagtcagacatcaagtggtacggcaagtccctcaacacccctttgtgacgcaccgtgatgttaacggttcagttcactcgcggctggcctttgtacttag

SEQ ID NO: 14211 - DNA, 356 bp, Artificial
  Mutation in BnaA.FAD2.a introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacactggctccctcgagagagacgaagtgtttgtccccaagaagaagtcagacatcaagtggtacggcaagtacctcaacaaccctttgggacgcaccgtgattttaacggttcagttcactctcggctggcctttgtacttag

SEQ ID NO: 14212 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctagtcatcgacgccaccattccaacactggctccctcgagagagacgaagtgtttgtccccaagaagaagtcagacatcaagtggtacggcaagtacctcaacaaccctttgggacgcatcgtgatgttaacggttcagttcactctcggctggcctttgtacttag

SEQ ID NO: 14213 - DNA, 291 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggaagactggctccctcgagagagacgaactgtttgtccccaagaagaagtcagacatcaagtggtacggcaagtacctcaacaaccctttgggacgcaccgtgatgttaacggttcagttcactctcggctggcctttgtacttag

SEQ ID NO: 14214 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtcttggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacatccctttgggacgcaccgtgatgttaacggttcagttcacgctcggctggcctttgtacttag

SEQ ID NO: 14215 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgccccgtgatgttaacggttcagttcactctcggctggcctttgtacttag

SEQ ID NO: 14216 - DNA, 346 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggcgccaccattccaacactggctccctcgagagagacgaagtgtttgtccccaagaagaagtcagacatcaagtggtacggcaagtacctcaacaaccctttgggacgcaccgtggtgttaacggttcagttcactctcggctggcctttgtacttag

SEQ ID NO: 14217 - DNA, 357 bp, Artificial
  Mutation in BnaA.FAD2.a introduced by TALE nuclease pair BnFAD2_T02
cctctcctccctcaccctctatcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttcacctggaaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtgcttag

SEQ ID NO: 14218 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgcctccattccaacactggctccctcgagagagacgaagtgtttgtccccaagaagaagtcagacatcaagtggtacggcaagtacctcaacagccctttgggacgcaccgtgatgttaacggtgcagttcactctcggctggcctgtgtacgtag

SEQ ID NO: 14219 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccttttggacgcaccgtgatgttaacggttcagttcactctcggctggcctttgtacttag

SEQ ID NO: 14220 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14221 - DNA, 351 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgcatcgacgccaccattccaacactggctccctcgagagagacgaagtgtttgtccccaagaagaagtcagacatcaagtggtacggcaagtacctcaacaaccctttgtgacgcaccgtgatgttaacggttcagttcactctcggctggcctttgtacttag

SEQ ID NO: 14222 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggcagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 14223 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggactttgtacttag

SEQ ID NO: 14224 - DNA, 437 bp, Artificial
  Mutation in BnaA.FAD2.a introduced by TALE nuclease pair BnFAD2_T02
cctctcctccctcaccctctatcctacttcgcctggcctctctactgggcctgccagggctgcgtcctaaccggcgtctggctcatagcccacgagtgcggccaccacgccttcagcgactaccagtggctggacgacaccgtcggcctcatcttccactccttcctcctcgtcccttacttctcctggaagtaccgtctccagcggctgttgccggtgctgtgccaggcccacggcttgaccccggagcaggtggtggccatcgccatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14225 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaataagaagtcacacatcaagtggtacggcaagtacctcaacaaccctttgggacgcaccgtgatgttaacggttcagttcacgctcggctggcctttgtacttag

SEQ ID NO: 14226 - DNA, 389 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacagcaacgtcggttcgagatggcgctcgaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14227 - DNA, 359 bp, Artificial
  Mutation in BnaA.FAD2.a introduced by TALE nuclease pair BnFAD2_T02
cctctcctccctcaccctctctactacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaacaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 14228 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 14229 - DNA, 357 bp, Artificial
  Mutation in BnaA.FAD2.a introduced by TALE nuclease pair BnFAD2_T02
cctctcctccctcaccctctaccttacctcacctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14230 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccgcgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 14231 - DNA, 358 bp, Artificial
  Mutation in BnaA.FAD2.a introduced by TALE nuclease pair BnFAD2_T02
cctctcctccctcaccctctcccttacctcggctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14232 - DNA, 340 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtccctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14233 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctgtcgacgccaccattccaacaccggatccctcgagagggatgaagtgttcgtccccaagaagaaatccgacatcaagtggtacggaaagtacctcaacaacccgctaggacgcacggtgatgctaaccgtccatttcactctcggctggcctttgtacttag

SEQ ID NO: 14234 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcatgcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 14235 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcactctcggctggcctttgtacttag

SEQ ID NO: 14236 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatcgcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14237 - DNA, 354 bp, Artificial
  Mutation in BnaA.FAD2.a introduced by TALE nuclease pair BnFAD2_T02
cctctcctccctcaccctctaccttacctcgcctggcccctctactgggcctgccaagggagcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttggaacgcaccgtgatgttaacggttcagttcactctcggctggcctttgtacttag

SEQ ID NO: 14238 - DNA, 448 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccgtggcggcgtgaccgcagtggaggcagtgcatgcatggcgccgatctacgcacgctcggctacagccagcagcaacaggagaagatcaaaccgaaggttcatcgacgccaccattccaacactggctccctcgagagagacgaagtggttgtccccaagaagaagtcagacatcaagtggtacggcaagtacctcaacaaccctttgggacgcaccgtgatgttaacggttcagttcactcgcggctggcctttgtacttag

SEQ ID NO: 14239 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagatcgacgccaccattccaacactggctccctcgagagagacgaagtgtttgtccccaagaagaagtcagacatcaagtggtacggcaggcacctcaacaacccttgtagacgcgccgtgatgttaaccgttcatttcagtcgtggctggccttagcacttag

SEQ ID NO: 14240 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcgaccaccacgccttcagcgactaccagtggcttgacgacaccgtcggtctcatcttccactccttcctccttgtcccttacttctcctggaaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 14241 - DNA, 340 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtccctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14242 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 14243 - DNA, 329 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacgacaccgtcggcctcatcttccactaccagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 14244 - DNA, 355 bp, Artificial
  Mutation in BnaA.FAD2.a introduced by TALE nuclease pair BnFAD2_T02
cctctcctccctcccctcttccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaatggttcagttcactctcggctggcctttgtacttag

SEQ ID NO: 14245 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactcctccctcctcgtcccttacttctcctggaaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 14246 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacatccctttgggacgccccgtgatgttaacggttcagttcacgctcggctggcctttgtacttag

SEQ ID NO: 14247 - DNA, 330 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 14248 - DNA, 359 bp, Artificial
  Mutation in BnaA.FAD2.a introduced by TALE nuclease pair BnFAD2_T02
cctctcctccctcaccctctccattacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14249 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14250 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 14251 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaccccgttgggacgcaccgtgatgttaacggttcagttcactcgcggctggcctttgtacttag

SEQ ID NO: 14252 - DNA, 399 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagccgaagtttccaaaaggtagttgatcaaagctcgccgcgttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14253 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcacggtgatgttaacggttcagttcactctcggctggcctttgtacttag

SEQ ID NO: 14254 - DNA, 352 bp, Artificial
  Mutation in BnaA.FAD2.a introduced by TALE nuclease pair BnFAD2_T02
cctctcctccctcaccctctctcctacttcgcatggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 14255 - DNA, 351 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctccatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14256 - DNA, 346 bp, Artificial
  Mutation in BnaA.FAD2.a introduced by TALE nuclease pair BnFAD2_T02
cctctcctctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14257 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgcctttgtacttag

SEQ ID NO: 14258 - DNA, 393 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccgctcgccatgcatgcactgcctccactgcggtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtactag

SEQ ID NO: 14259 - DNA, 355 bp, Artificial
  Mutation in BnaA.FAD2.a introduced by TALE nuclease pair BnFAD2_T02
cctctctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggctggcctttgtacttag

SEQ ID NO: 14260 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtccattacttctcctggaagttacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14261 - DNA, 356 bp, Artificial
  Mutation in BnaA.FAD2.a introduced by TALE nuclease pair BnFAD2_T02
cctctcctcccgcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14262 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagagtcatcgacgccaccattccaacactggctccctcgagagagacgaagtgtttgtccccaagaagaagtcagacatcaagtggtacggcaagtccctcaacaaccccttgggacgcaccgtgatgttaacggttcagtgcaccttcggctggccttggtccgtag

SEQ ID NO: 14263 - DNA, 357 bp, Artificial
  Mutation in BnaA.FAD2.a introduced by TALE nuclease pair BnFAD2_T02
cctctcctccctcaccctctctcctacttcgcctggcctctctactgggcctgcaagggctgcgtcctaaccggcgtctgggtcatcgcccacgagtgcggccaccacgccttcagcgactaccagtggctggacgacaccgtcggcctcatcttccactccttcctcctcgtcccttacttctcctggaagatcatcgacgccaccattccaacactggctccctcgagagagacgaagtgtttgtccccaagaagaagtcagacatcaagtggtacggcaagtacctcaacaaccctttgggacgcacggtgatgttaacggttcagttcacgctcggctggcctttgtacttag

SEQ ID NO: 14264 - DNA, 416 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcctcttccactccttcctcctcgtcccttacttctcctggatctccagcgcctgcttgccgccctcgtggcccacggcttgaccccccagcaggtggtggcagtcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggctggcctttgtacttag

SEQ ID NO: 14265 - DNA, 340 bp, Artificial
  Mutation in BnaA.FAD2.a introduced by TALE nuclease pair BnFAD2_T02
cctctcctccctcaccctctctcctacttcgcctggcctctctactgagcctgccaagggtgcgtcctaaccggcgtctgggtcatagcccacgagtgcggccaccacgccttcagcgactaccagtggctggacgacaccgtcggcctcgtcttccactccttcctcctcgtcttccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggccttagtacttag

SEQ ID NO: 14266 - DNA, 336 bp, Artificial
  Mutation in BnaA.FAD2.a introduced by TALE nuclease pair BnFAD2_T02
cctctcctccctcaccctctcccttacctcgcctggcccctctactgggcctgccgaggctgcgtcctaacgggcctctgggtcatcgcccacgaatgcagccaccacgccttcagcgaccaccagtggctggacgacgccgtgggcctcgtcttccactccttcctcctcgtcatcgacgccaccattccaacactggctccctcgagagagacgaagtgtttgtccccaataagaagtcagacatcaagtggtacggcaagtacctcaacaaccctttgggacgcaccgtgatgttaacggttcagttcactctcggctggcctttgtacttag

SEQ ID NO: 14267 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14268 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaagtaccgcaacagccctttgggacgcgccgtgatggtaacggttcagttcgctcgcggctggccgttgtacttag

SEQ ID NO: 14269 - DNA, 462 bp, Artificial
  Mutation in BnaA.FAD2.a introduced by TALE nuclease pair BnFAD2_T02
cctctcctccctcaccctctctcctacttcgcctggactctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccgtctccagcgcctgcttgccgccatcgtggctggcgatggccaccacctgctccggggtcaagccgtgggcctggcacagccccggcaccagccgctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcatttcactcgcggctggcctttgtacttag

SEQ ID NO: 14270 - DNA, 315 bp, Artificial
  Mutation in BnaA.FAD2.a introduced by TALE nuclease pair BnFAD2_T02
cctctcctccctcaccctctcccttacctcgcctggccaccctactgggcctgccaaggctgcgccctaacgggcctctgggtcatcgcccacgaatgcggccaccacgccttcagcgaccaccaatggcggtggcaagcaggcgctggagccatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 14271 - DNA, 411 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacagagcgaggtatgtaggcggtgctacagagttcttgaagtggtggcctacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 14272 - DNA, 349 bp, Artificial
  Mutation in BnaA.FAD2.a introduced by TALE nuclease pair BnFAD2_T02
cctctcctccctcaccctctcccctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcccatcgacgccaccattccaacactggctccctcgagagagacgaagtgtttgtccccaagaagaagtcagacatcaagtggtacggcaagtacctcaacaacccgttgggacgcaccgggatcttaacggttcagttcactctcggctggcctttgtacttag

SEQ ID NO: 14273 - DNA, 357 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 14274 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgcctgcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 14275 - DNA, 332 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacgtctcctggaactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 14276 - DNA, 359 bp, Artificial
  Mutation in BnaA.FAD2.a introduced by TALE nuclease pair BnFAD2_T02
cctctcctccctcaccctgtctactacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14277 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccacaattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14278 - DNA, 355 bp, Artificial
  Mutation in BnaA.FAD2.a introduced by TALE nuclease pair BnFAD2_T02
cctctcctccctcaccctctctcctacttcgcctggcctctctcctcggcctgccagggctgcgtcctaaccggcgtctgggtcatagcccacgagtgcggccaccacgccttcagcgactaccagtggcttgacgccaccgtcggtctcatcttccactccttcctcctcgtcccttacttctcctggaatcatcgacgccacccttccaacactggctccctcgagagagacgaagtgtttgtccccaagaagaagtcagacatcaagtggtacggcaagtaccccaacatccgttcgggacgccgcgtggtgttaacggttcaggtcaggcccggctggcctttgtacttag

SEQ ID NO: 14279 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14280 - DNA, 357 bp, Artificial
  Mutation in BnaA.FAD2.a introduced by TALE nuclease pair BnFAD2_T02
cctcttctccctcaccctctcacctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14281 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14282 - DNA, 329 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggctggacgacaccgtcggcctcatcttccactaccagtcatcgacgccaccattccaacaccggatccctcgagagggatgaagtgttcgtccccaagaagaaatcagacatcaagtggtacggaaagtacctcaacaacccgctaggacgcacggtgatgctaaccgtccagttcacgctcggctggcctttgtacttag

SEQ ID NO: 14283 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactcgcggctggcctttgtacttag

SEQ ID NO: 14284 - DNA, 357 bp, Artificial
  Mutation in BnaA.FAD2.a introduced by TALE nuclease pair BnFAD2_T02
cctctcctccctcaccctctctcctacttcgcctggactctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaaggaccgcaacatcccattgggatgcgcggtgatgctaacggttcatgtcactctccgctggcccttgtacttag

SEQ ID NO: 14285 - DNA, 352 bp, Artificial
  Mutation in BnaA.FAD2.a introduced by TALE nuclease pair BnFAD2_T02
cctctcctccatcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 14286 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaatcatcgacgccaccattccaacactgactccctcgagagagacgaagtgtttgtccccaagaagaagtcagacatcaagtggtacggcaagtacctcaacaaccctttgggacgcaccgtgatgttaacggttcagtttactctcggctggcctttgtacttag

SEQ ID NO: 14287 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 14288 - DNA, 358 bp, Artificial
  Mutation in BnaA.FAD2.a introduced by TALE nuclease pair BnFAD2_T02
cctctcctccctcaccctctcccttacctcgcctggccactctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14289 - DNA, 357 bp, Artificial
  Mutation in BnaA.FAD2.a introduced by TALE nuclease pair BnFAD2_T02
cctctcctccctcaccctctctcctacttcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14290 - DNA, 468 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagtagcggctgttgccggtgctgtgccaggcccacggcttgaccccccagcaggtggtggccatcgccagcaataatggtggcaagcaggcgctggagacggtccagcggctgtatcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 14291 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacccaaacaaccatgtgggacgcaccgtgctgttaaccgttcagttcactctcggctggcctttgtacttag

SEQ ID NO: 14292 - DNA, 378 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatatggcggcaagcaggcgctggagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 14293 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 14294 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14295 - DNA, 357 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14296 - DNA, 352 bp, Artificial
  Mutation in BnaA.FAD2.a introduced by TALE nuclease pair BnFAD2_T02
cctctcctccctcaccctctctcctacttcgcctggcctctctactgtgcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 14297 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcccatcgacgccaccattccaacactggctccctcgagagagacgaagtgtttgtccccaagaagaagtcagacatcaagtggtacggcaagtacctcaacaaccctttgggacgcaccgtgatgttaacggttcagttcgctctcggctggcctttgtacttag

SEQ ID NO: 14298 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14299 - DNA, 357 bp, Artificial
  Mutation in BnaA.FAD2.a introduced by TALE nuclease pair BnFAD2_T02
cctctcctccctcaccctctatcctacttcgcctggcttctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttatcggttcatttcactctcgtctggcctttgtacttag

SEQ ID NO: 14300 - DNA, 294 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctccttgtcaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 14301 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14302 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14303 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccttcatcgacgccaccattccaacactggctccctcgagagggatgaagtgttcgtccccaagaagaaatccgacatcaagtggtacggaaagtacctcaacaacccgctaggacgcacggggatgctaaccgtccagttcacgctcggctggcctttgtacttag

SEQ ID NO: 14304 - DNA, 387 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtccctttgcctggcacagcaccggcaacagccgctggaccgtctccagctgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14305 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14306 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcatcgtgatgttaacggttcagttcactctcggctggcctttgtacttag

SEQ ID NO: 14307 - DNA, 353 bp, Artificial
  Mutation in BnaA.FAD2.a introduced by TALE nuclease pair BnFAD2_T02
cctctcctccctcaccctttctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14308 - DNA, 353 bp, Artificial
  Mutation in BnaA.FAD2.a introduced by TALE nuclease pair BnFAD2_T02
cccctcctccctcaccttctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggccgttgtacttag

SEQ ID NO: 14309 - DNA, 357 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccgtcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14310 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttcacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14311 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14312 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagccaacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttgactctcggctggcctttgtacttag

SEQ ID NO: 14313 - DNA, 441 bp, Artificial
  Mutation in BnaA.FAD2.a introduced by TALE nuclease pair BnFAD2_T02
cctctcctccctcaccctctctactacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcggcccttacttctcctggaagctcggtttgatcgacagtggcgcagcaccacgaggcactggtcggccacgggattacacacgcgcacatcgttgcgttaagccagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 14314 - DNA, 357 bp, Artificial
  Mutation in BnaA.FAD2.a introduced by TALE nuclease pair BnFAD2_T02
cctctcctccctcaccctctatcctacttcgcctggcctctctactgggcctgccagggctgcgtcctaaccggcgtctgggtcatagcccacgagtgcggccaccacgccttcagcgactaccagtggctggacgacaccgtcggcaacatcttccactccttcctcctcgtcccttacttctcctggaagatcatcgacgccaccattccaacactggctacctcgagagagacgaagtgtttgtccccaagaataagtcagccatcaagtggtacggcaagttcctcaacaaccctttgggacgcaccgtgatgttaacggttcagttcactctttgctggcctttgtacttag

SEQ ID NO: 14315 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggcacatcgacgcccccactccaacactcgctcccgcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14316 - DNA, 348 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctccatcgacgccaccattccaacactggctccctcgagagagacgaagtgtttgtccccaagaagaagttagacatcaagtggtacggcaagtacctcaacaaccctttgggacgcaccgtgatgttaacggttcagttcattctcggctggcctttgtacttag

SEQ ID NO: 14317 - DNA, 358 bp, Artificial
  Mutation in BnaA.FAD2.a introduced by TALE nuclease pair BnFAD2_T02
cctctcctccctcaccatctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtatcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 14318 - DNA, 355 bp, Artificial
  Mutation in BnaA.FAD2.a introduced by TALE nuclease pair BnFAD2_T02
cctctcctccctcaccctctctactacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14319 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcacgctcggctggcctttgtacttag

SEQ ID NO: 14320 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14321 - DNA, 391 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtaggtcgttcgctccaagctgggctgtgtgcacgaatcgacgccaccattccaacactggctccctcgagagagacgaagtgttcgtccccaagaagaagtcagacatcaagtggtacggcaagtacctcaacaaccctttgggacgcaccgtgatgttaaccgttcagttcactctcggctggcctttgtacttag

SEQ ID NO: 14322 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggcttgacgacaccgtcggtctcatcttccactccttcctcctcgttccttacttctcctggaagttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14323 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggttggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14324 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagctactaccagtggcttgacgacaccgtcggtctcatcttccactccttcctcctcgtcccttacttctcctggaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 14325 - DNA, 346 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggatggcctttgtacttag

SEQ ID NO: 14326 - DNA, 468 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagggaccgtctccagcgcctgcttgccaccattattgctggcgatggccaccacctgctggggggtcaagccgtgggcctggcacagcaccggcaacagccgctggaccgtctccagcgcctgctaacaatccaacactggctccctcgagagagacgaagtgtttgtccccaagaagaagtcagacatcaagtggtacggcaagtacctcaacaaccctttgggacgcaccgtgatgtgaacggttcagttcactctcggctggcctttgtacttag

SEQ ID NO: 14327 - DNA, 323 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtcggcctcatcttccactccttcctcctcgtcccttacttctcctggaagtaccgctcgccgcagccgaacgaccgagaagaagtcagacatcaagtggtacggcaagtacctcaacaaccctttgggacgcaccgtgatgttaacggttcagttcactctcggctggcctttgtacttag

SEQ ID NO: 14328 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgttgttaacggttcagttcactctcggctggcctttgtacttag

SEQ ID NO: 14329 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14330 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14331 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcctctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 14332 - DNA, 352 bp, Artificial
  Mutation in BnaA.FAD2.a introduced by TALE nuclease pair BnFAD2_T02
cctctcctcctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14333 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgtaaacggttcagttcacgctcggctggcctttgtacttag

SEQ ID NO: 14334 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtacccaagaagaagtcagacatcaagtggtacggcaagtacctcaacaaccctttgggacgcaccgtgatgttaacggttcagttcactcgcggctggccttcgtacttag

SEQ ID NO: 14335 - DNA, 312 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcgacgccaccattccaacactggctccctcgagagagacgaagtgtttgtccccaagaagaagtcagacatcaagtggtacggcaagtacctcaacaacccttggtgacgcaccgtgatgttaacggttcagttctgtcgcggctggcctttgtacttag

SEQ ID NO: 14336 - DNA, 358 bp, Artificial
  Mutation in BnaA.FAD2.a introduced by TALE nuclease pair BnFAD2_T02
cctctcctccctcaccctctctactacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaacccttggggacgcacggtggttctaacggttcatgtcactctcggctggcctttgtacttag

SEQ ID NO: 14337 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctccttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14338 - DNA, 356 bp, Artificial
  Mutation in BnaA.FAD2.a introduced by TALE nuclease pair BnFAD2_T02
cctctcctccctcaccctctcccttacctagcctggcctctctactgggcctgccagggctgcgtccaaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtaaggcaagtacctcaacaacccgttaggacgcactgtgattctaaccgtgaagctctctcttggttggcatttgtacttag

SEQ ID NO: 14339 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcatttgtacttag

SEQ ID NO: 14340 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 14341 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtaccgcaacaaccctttgggacgcaccgggatgttaacggttcagttcactctcggctggcctttgtacttag

SEQ ID NO: 14342 - DNA, 474 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaagtacagccgctggagacgtctccagcggctgtttgccgccatcgtggctggcgatggccaccccctgctccggggtaaagccgtggccctggcacagcaccggcaacagccgctggaccgtctcgacgccaccattccaacactggctccctcgagagagacgaagtgtttgtccccaagaagaagtcagacatcaagtggtacggcaagtaccgcaacaacccttggggacgctccgtgatgtgaacggttcagttcactctcggctggcatttgtacttag

SEQ ID NO: 14343 - DNA, 329 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactaccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14344 - DNA, 355 bp, Artificial
  Mutation in BnaA.FAD2.a introduced by TALE nuclease pair BnFAD2_T02
cctctcctccctcaccctctctcctacttcgcctggcctctcaactgggcctgccagggctgcgtcctaaccggcgtctgggtcatagcccacgagtgcggccaccacgccttcagcgactaccagtggcaggacgacaccgtcggcctcatcttccactccttcctcctcgacccttacttcacctggagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 14345 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 14346 - DNA, 357 bp, Artificial
  Mutation in BnaA.FAD2.a introduced by TALE nuclease pair BnFAD2_T02
cctctcctccctcaccctctatcctacttcgcctggcctctctactgggcctgccagggctgcgtcctaaccggcgtctgggtcatagcccacgagtgcggccaccacgccttcagcgactaccagtggcttgacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 14347 - DNA, 341 bp, Artificial
  Mutation in BnaA.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtccagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 14348 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14349 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcactgtgatgttaacggttcagttcactctcggctggcctttgtacttag

SEQ ID NO: 14350 - DNA, 337 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcttccacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14351 - DNA, 354 bp, Artificial
  Mutation in BnaA.FAD2.a introduced by TALE nuclease pair BnFAD2_T02
cctctcctccctcaccctctctcctacttcacctggcctctctactgggcctgccagggctgcgtcccaaccggcgtctgggtcatagcccacgagtgcggccaccacgccttcagcgactaccagtggctggacgacaccgtcggcctcatcttccactccttcctcctcgtcccttacttctcctggatcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 14352 - DNA, 348 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccttcgacgcctccactccaacactggctccctcgagagagacgaagtgtttgtccccaagaagaagtcagacatcaagtggtacggcaagtacctcaacacccctttgggacgcaccgtgatgttaacggttcagttcattcgcggctggccattatacttag

SEQ ID NO: 14353 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttggacttag

SEQ ID NO: 14354 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14355 - DNA, 354 bp, Artificial
  Mutation in BnaA.FAD2.a introduced by TALE nuclease pair BnFAD2_T02
cctctcctccctcaccctctctcctacttctcctggcctctctactgggcctgccagggctgcgccctaaccggcgtctgggtcatagcccacgagtgcggcccccacgccttcagcgactaccagtggctggacgacaccgtcggcctcatcttccactccttcctcctcgtcccttacttctcctcagtcatcgacgccaccattccaacactggctccctcgagagagacgaagtgtttgtccccaagaagaagtcagacatcaagtggtccgtcaagtaccccaacacccctgtgggacgcaccgtgatgttaacggttcagttccctctcggctggcctttgtacttag

SEQ ID NO: 14356 - DNA, 416 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatctccagcgcctgcttgccgccatcgtggcccacggcttgaccccccagcaggtggtggcagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 14357 - DNA, 355 bp, Artificial
  Mutation in BnaA.FAD2.a introduced by TALE nuclease pair BnFAD2_T02
cctctcctccctcaccctctctactacttcgccaggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggaagtatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 14358 - DNA, 346 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttactcctcctggagccaccattccaacactggctccctcgagagagacgaagtgtttgtccccaagaagaagtcagacatcaagtggtacggcaagtacctcaacaaccctgtgggacgcaccgtgttgttgacggttcagttcactcccggctggccgttgtacttag

SEQ ID NO: 14359 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggcctcatcttccactccttcctcctcgtcccttacttctccagtagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 14360 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctacagtcatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14361 - DNA, 330 bp, Artificial
  Mutation in BnaA.FAD2.a introduced by TALE nuclease pair BnFAD2_T02
cctctcctccctcaccctctcccttacctcgcctggccactctactgggcctgccaaggctgcgtcctaacgggcctctgggtcatagcccacgagtgcggccaccacgccttcagcgactaccagtggctggacgacaccgtcggcctcatcttccactccttcctcatcgacgccaccattccaacactggctccctcgagagagacgaagtgtttgtccccaagaagaagtcagacatcaagtggtacggcaagtacctcaacaaccctttgggacgcaccgggatggtaacggttcagttcactctcggctggcctttgtacttag

SEQ ID NO: 14362 - DNA, 387 bp, Artificial
  Mutation in BnaA.FAD2.a introduced by TALE nuclease pair BnFAD2_T02
cctctcctccctcaccctgtctcctacttcgcctggcctctctactcggcctgcccagggcgcgtcctaaccggcgtctgggtcatagcccacgagtgcggccaccacgccttcagcgactaccagtggctggacgacaccgtcggcctcatcttccactccttcctcctcgtccctttgcctggcacaccaccggcaacagccgctggaccgtctccagctgtcatcgacgccaccattccaacactggctccctcgagagagacgaagtgtttgtccccaagaagaagtcagacatcaagtggtacggcaagtacctcaacaaccctttgggccgcaccgtgatgttaacggttcagttcactctcggctggcctttgtacttag

SEQ ID NO: 14363 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttggtacttag

SEQ ID NO: 14364 - DNA, 394 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaagtaccgctcgccatgcatgcactgcctccactgcggtagtcatcgacgccaccattccaacactggctccctcgagagagacgaagtgtttgtccccaagaagaagtcagacatcaagtggtacggcaagtacctcaacatccctttgggacgcaccgtgattttaacggttcagttcactctcggctggcctttgtacttag

SEQ ID NO: 14365 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctcttggtcatcgcccacgaatgcggccaccacgccttcagcgactaccagtggctggacgacaccgtcggcctcatcttccactccttcctcctcgtcccttacttctcctagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14366 - DNA, 356 bp, Artificial
  Mutation in BnaA.FAD2.a introduced by TALE nuclease pair BnFAD2_T02
cctctcctccctcaccctctctcctacttcgcctggccactctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacacccctttgggacgcacggtgatgttacccgttcagttccctctcggctggcctttgtacttag

SEQ ID NO: 14367 - DNA, 391 bp, Artificial
  Mutation in BnaA.FAD2.a introduced by TALE nuclease pair BnFAD2_T02
cctctcctccctcaccctctctcctacttcgcctggcctctctactgggcctgccaagggcgcgtcctaaccggcgtctgggtcatcgcccacgaatgcggccaccacgccttcagcgaccaccagtggctggacgacgccgtgggcctcgtcttccactccttcctcctcgtcccttacttctcctggaagtaggcgctaaatgaaaccttaacgctatggaacagtcatcgacgccaccattccaacactagctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14368 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaagggcgcgtcctaaccggcgtctgggtcatagcccacgagtgcggccaccacgccttcagcgactaccagtggctggacgacaccgtcggcctcatcttccactccttcctcctcgtcccttacttctcctggaagcagtcatcgacgccaccattccaacactggctccctcgagagagacgaagtgtttgtccccaagaagaagtcagacatcaagtggtacggcaagtacctcaacaaccctgtgggacgcaccgggatgttaacggttcagttcactctcggctggcctttgtacttag

SEQ ID NO: 14369 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaacgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14370 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggtgggcctttgtacttag

SEQ ID NO: 14371 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 14372 - DNA, 341 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14373 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacggggctctgggtcatcgcccacgaatgcggccaccacgccttcagcgaccaccagtggcttgacgacgccgtgggcctcgtcttccactccttcctcctcgtcccttacttctcctggagtcatcgacgccaccattccaacactggctccctcgagagagacgaagtgtttgtccccaagaagaagtcagacatcaagtggtacggcatgtacctcaacagccctgtaggacgcaccgggattttatcggttcagttcactcttggctggcctttgtacttag

SEQ ID NO: 14374 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 14375 - DNA, 273 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacaaatgcggccaccacgccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14376 - DNA, 349 bp, Artificial
  Mutation in BnaA.FAD2.a introduced by TALE nuclease pair BnFAD2_T02
cctctcctccctcaccctatctcctacttcgcctggcctctctactgggcctgccagggctgcgtcctaaccggcgtctgggtcatagcccacgagtgcggccacaccgccttcagcgactaccagtggctggacgacaccgtcgacctcatcttccactccttctacctcgtcccttacttccgtcatcgacgccaccattccaacactggctccctcgagagagacgaagtgtttgtccccaataagaagtcagacaacgagtggtacggcaagtacctcaacaaccctgtgggacgcacggtgatgttaacggtgcagttcactctcggctggccttagtactgag

SEQ ID NO: 14377 - DNA, 329 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcggcgactaccagtggctggacgacaccgtcggcctcatcttccactaccagtcatcgacgccaccattccaacactggctacctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14378 - DNA, 351 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggcctcatcttccactccttcctcctcgtcccttacttctccttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14379 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttactactcctggaaggcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14380 - DNA, 339 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14381 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 14382 - DNA, 346 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14383 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaaggccgcgtcctaacgggcggctgggtcatcgcccacgagtgcggccaccacgccttcagcgactaccagtggctggacgacaccgtcggcctcgtcttccactccttcctcctcgtcccttacttctcctggaagtcatcgacgccaccattccaacactggctccctcgagagagacgaagtgttctgacccaagaagaagtcagacatcaagtggtccggcaagtaccgcaacgacccattgggacgcaccgggatggtaaccctccagtccactctcggctggcctttgtacttag

SEQ ID NO: 14384 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 14385 - DNA, 336 bp, Artificial
  Mutation in BnaA.FAD2.a introduced by TALE nuclease pair BnFAD2_T02
cctctcctccctcaccctgtctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaataagaagccagacatcaagtggtacggcaagtaccccaacaacccttttggacgcaccgtgaggttaacggttcagttcactctcggctggccttagcacttag

SEQ ID NO: 14386 - DNA, 341 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14387 - DNA, 356 bp, Artificial
  Mutation in BnaA.FAD2.a introduced by TALE nuclease pair BnFAD2_T02
cctctcctccctcaccctctctcctacttcgcctggccaccctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccatcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14388 - DNA, 363 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatacagtcatcgacgccaccattccaacactggctccctcgagagagacgaagtgtttgtccccaagaagaagtcagacatcaagtggtacggcaagtacctcaacaaccctttgggacgcaccgtgattttaacggttcagttcactctcggctggcctttgtacttag

SEQ ID NO: 14389 - DNA, 356 bp, Artificial
  Mutation in BnaA.FAD2.a introduced by TALE nuclease pair BnFAD2_T02
cctctcctccctcaccctctaccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccacgaagaagtcagacatcaagtggtacggcaagtacatcaacacccctttgggacgcaccgtgatgttcacggttcagttcactctcggctggcctttgtacttag

SEQ ID NO: 14390 - DNA, 353 bp, Artificial
  Mutation in BnaA.FAD2.a introduced by TALE nuclease pair BnFAD2_T02
cctctcctccctcaccctctctactacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccttgtcatcgacgccaccattccaacactggctccctcgagagagacgaagtgtttgtccccaagaagaagtcagacatcaagtggtacggcaagtacctcaacaaccctttgggacgcaccgtgattttaacggttcagtttacgctcggctggcctttgtacttag

SEQ ID NO: 14391 - DNA, 428 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtggcgatggccaccacctgctccggggtcaagccgtgggcctggcacagcaccggcaacagccgctgggcagtcatcgacgccaccattccaacactggctccctcgagagagacgaagtgtttgtccccaagaagaagtcagacatcaagtggtacggcaagtacctcaacaacccttttggacgcaccgtgatgttaacggttcagttcactctcggctggcctttgtacttag

SEQ ID NO: 14392 - DNA, 352 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacactggctccctcgagagagacgaagtgtttgtccccaagaagaagtcagacatcaagtggtacggcaagtacctcaacaaccctttgggacgccccgtgatgttaacggttcagttcactctcggctggcctttgtacttag

SEQ ID NO: 14393 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaagaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 14394 - DNA, 419 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcctcttccactccttcctcctcgtcccttacttctcctggaagtacattccgtggcgttatccagctaagcgcgaactgcaatttggagaatggcagcgcaatgacacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14395 - DNA, 336 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14396 - DNA, 359 bp, Artificial
  Mutation in BnaA.FAD2.a introduced by TALE nuclease pair BnFAD2_T02
cctctcctccctcaccctttctcctacttcgcctggactaactactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcatttctctcgctgttggccttcgtacttag

SEQ ID NO: 14397 - DNA, 323 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtaccgctcgccgcagccgaacgaccgagaagaagtcagacatcaagtggtacggcaagtacctcaacaaccctttgggacgcaccgtgatgttaacggttcagttcactctcggctggcctttgtacttag

SEQ ID NO: 14398 - DNA, 358 bp, Artificial
  Mutation in BnaA.FAD2.a introduced by TALE nuclease pair BnFAD2_T02
cctctcctccctcaccctctctcctacttcgcctgacctctctactgggcctgccaagggagcgtcctaaccggcgtctgggtcatagcccacgagtgcggccaccacgccttcagcgactaccagtggctggacgacaccgtcggcctcatcttccactccttcctcctcgtcccttacttctcctggaagagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14399 - DNA, 318 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14400 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctgtacgacaccgtcggcctcatcttccactccttcctcctcgtcccttacttctcctggatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14401 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccgttgggacgcaccgggatgttaacggttcagttcactcgcggctggcctttgtacttag

SEQ ID NO: 14402 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagtgaccaccagtggctggacgacgccgtgggcctcgtcttccactccttcctcctcgtcccttacttctcctggccatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggcctttgtacttag

SEQ ID NO: 14403 - DNA, 350 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactcctttctcctcgtcccttactcctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14404 - DNA, 443 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttactcctcgtcccttacttctcctggaagcaggtggtggccatcgccagcaatggcggtggcaagcaggcgctggagacggtccagcggctgttgccggtgctgtgccaggcccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14405 - DNA, 353 bp, Artificial
  Mutation in BnaA.FAD2.a introduced by TALE nuclease pair BnFAD2_T02
cctctcctccctcaccttctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14406 - DNA, 273 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14407 - DNA, 354 bp, Artificial
  Mutation in BnaA.FAD2.a introduced by TALE nuclease pair BnFAD2_T02
cctctcctccctcaccctctctcctacttcgcctggccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtaccttaacacccctttgggacgcaccgtgatgttaacggttcagttcactcgcgggtggcctttgtacttag

SEQ ID NO: 14408 - DNA, 356 bp, Artificial
  Mutation in BnaA.FAD2.a introduced by TALE nuclease pair BnFAD2_T02
cctctcctccctcaccctctaccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcgggcctttgtacttag

SEQ ID NO: 14409 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgtggtacttag

SEQ ID NO: 14410 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14411 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagggatgaagtgttcgtccccaagaagaaatccgacatcaagtggtacggaaagtacctcaacaacccgctaggacgcacggtgatgctaaccgtccagtgcacgctcggctggcctttgtacttag

SEQ ID NO: 14412 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 14413 - DNA, 345 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14414 - DNA, 311 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgaatgcggccaccacgccttcagcgactaccagtggcttaacgacaccgtcggtctcatcgacgccaccattccaacactggctccctcgagagggatgaagtgtttgtccccaagaagaagtcagacatcaagtggtacggcaagtacctcaacaaccctttgggacgcaccgtgatgttaacggttcagttcactctcggctggcctttgtactta

SEQ ID NO: 14415 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggcctttgtacttag

SEQ ID NO: 14416 - DNA, 348 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14417 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 14418 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccatgccttcagcgactaccagtggctggacgacaccgtcggcctcatcttccactccttcctcctcgtcccttacttctcctggaaagtcatcgacgccaccattccaacactggctccctagagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14419 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagtcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14420 - DNA, 400 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggcgctggagacggtccagcggctgttgccggtgctgtgccaatagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtattag

SEQ ID NO: 14421 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 14422 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 14423 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14424 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaaagtcatcgacgccaccattccaacactggctccctcgagagagacgaagtgtttgtccccaagaagaagtcagacatcaagtggtacgccaagtacctcaacaaccctttgggacgcacattgatgttaacggttcagttcactctcggctggcctttgtccttag

SEQ ID NO: 14425 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 14426 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacaccggatccctcgagagggatgaagtgttcgtccccaagaagaagtcagacatcaagtggtacggcaagtacctcaacaaccctttgggacgcaccgggatgttaacggttcagttcactctcggctggcctttgtacttag

SEQ ID NO: 14427 - DNA, 291 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccattccaacactggctccctcgagagagacgaagtgtttgtccccaagaagaagtcagacatcaagtggtacggcaagtacctcaacaaccctttgggacgcaccgtgatgttaacggttcaggtcactctcggctggcagttgtacttag

SEQ ID NO: 14428 - DNA, 288 bp, Artificial
  Mutation in BnaA.FAD2.a introduced by TALE nuclease pair BnFAD2_T02
cctctccctcaccctctctcctacttcgcctggcctctctactgggcctgccagggctgcgtcctaaccggcgtctgggtcatagcccacgagtgcggccaccacgccttcagcgactaccagtggctggacgacaccgtcggaagactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14429 - DNA, 360 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttcaactccttcctcctcgtcccttacttctcctggaagtcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14430 - DNA, 345 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttcttcgacgccaccattccaacactggctccctcgagagagacgaagtgtttgtccccaagaagaagtcagacatcaagtggtacggcaagtacctcaacaaccctttgggccgctccgtgatgttaccggttcagttcactctcggctggcctttgtacttag

SEQ ID NO: 14431 - DNA, 354 bp, Artificial
  Mutation in BnaA.FAD2.a introduced by TALE nuclease pair BnFAD2_T02
cctctcctccctcaccctttcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccattgtacttag

SEQ ID NO: 14432 - DNA, 378 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggatatggcggcaagcaggcgatggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14433 - DNA, 354 bp, Artificial
  Mutation in BnaA.FAD2.a introduced by TALE nuclease pair BnFAD2_T02
cctctcctccctcaccctctcccttacctcgcctggccactctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagatcgacgccaccattccaacactggctccctcgagagagacgaagtgtttgtccccaagaagaagtcagacatcaagtggtacggcaagtacctcaacaaccctttgggacgcaccgtgatgtgaacggttcagttcactctcggctggccttgctacttag

SEQ ID NO: 14434 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttggtacttag

SEQ ID NO: 14435 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccactattccaacactggctccctcgagatagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 14436 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaagcctttgggacgcaccgtgatgttaacggttcagttcactctcggctggcctttgtacttag

SEQ ID NO: 14437 - DNA, 354 bp, Artificial
  Mutation in BnaA.FAD2.a introduced by TALE nuclease pair BnFAD2_T02
cctctcctccctcaccctttctcctacttcgcctggcctctctactgggcctgccagggctgcgtcctaaccggcgtctgggtcatagcccacgagtgcggccaccacgccttcagcgactaccagtggctcgacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccccttgggacgcgccgtgatgttaacggttcagttcactctcggctggccttagtacttag

SEQ ID NO: 14438 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtatcatcgacgccacaattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14439 - DNA, 339 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctccaccatttcaacactggcttcctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 14440 - DNA, 357 bp, Artificial
  Mutation in BnaA.FAD2.a introduced by TALE nuclease pair BnFAD2_T02
cctctcctccctcaccctctctcctacttcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 14441 - DNA, 357 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 14442 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 14443 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggcttgacgacaccgtcggtctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 14444 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacacgggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14445 - DNA, 318 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14446 - DNA, 355 bp, Artificial
  Mutation in BnaA.FAD2.a introduced by TALE nuclease pair BnFAD2_T02
cctctcctccctcaccctctctcctacttcgcctggcctctctactgtgcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14447 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttctctctcggctggcctttgtacttag

SEQ ID NO: 14448 - DNA, 348 bp, Artificial
  Mutation in BnaA.FAD2.a introduced by TALE nuclease pair BnFAD2_T02
cctctcctccctcaccctctctcctacttcgcctggactctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttagtcatcgacgccaccattccaacactggctccctcgagagagacgaagtgtttgtccccaagaagaagtcagacatcaagtggtacggcaagtacctcaacatcccttggggacgcgccgtggtgttaacggttcagttcgctcttggctgccctttgtacgtag

SEQ ID NO: 14449 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgcattcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtacggcaaggaccgcaacaacccttggggacgcaccgtgatgttagcggttcaggtcgctcgcgggtggcagttgtacttag

SEQ ID NO: 14450 - DNA, 312 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacaccgtcggcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14451 - DNA, 315 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccaatggcggtggcaagcaggcgctggagccatcgacgccaccattccaacactggctccctcgagagagacgaagtgtttgtccccaagaagaagtcagacatcaagtggtacggcaagtacctcaacaacccttggggacgcaccgtggtcttaacggttcagttcactctcggctggccttagtacttag

SEQ ID NO: 14452 - DNA, 291 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgccaccattccaacactggctccctcgagagagacgaagtgtttgtccccaagaagaagtcagacatcaagtggtacggcaagtacctcaacaaccctttgggacgcaccgtgatgttaacgggtcagtgcactcgcggctggcaatagtacttag

SEQ ID NO: 14453 - DNA, 319 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacctgcgtctgggtcatagcccacgagtgcggccaccacgccttcagcgactaccagtggcttgacgacaccgtcggtctcatcttccactccttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14454 - DNA, 336 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14455 - DNA, 389 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtctggcgccgtcgggcttcctggagccgcccagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14456 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14457 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctgaaaatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggcttgcctttgtacttag

SEQ ID NO: 14458 - DNA, 318 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgtggccaccacgccttcagcgactaccagtggctggacgacaccgtcggcctcatcttccactccttcctcctcgtcccttacttctcctggagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14459 - DNA, 291 bp, Artificial
  Mutation in BnaA.FAD2.a introduced by TALE nuclease pair BnFAD2_T02
cctctcctccctcaccctctctcctacttcgcctggcctctctacttggcctgccagggctgcgtcctaaccggcgtctgggtcatagcccacgagcgcggccaccacgccttcagcgactaccagtggcttgacgacaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 14460 - DNA, 356 bp, Artificial
  Mutation in BnaA.FAD2.a introduced by TALE nuclease pair BnFAD2_T02
cctctcctccctcaccctatccattacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 14461 - DNA, 356 bp, Artificial
  Mutation in BnaA.FAD2.a introduced by TALE nuclease pair BnFAD2_T02
cctctcctccctcaccctctctcctacttcgcctggcatctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14462 - DNA, 351 bp, Artificial
  Mutation in BnaA.FAD2.a introduced by TALE nuclease pair BnFAD2_T02
cctctcctccctcaccctctccgttacctcgcctggcccctctactgcgcctgccaaggctgcgtcctaaccggcgtctgggtcatagcccacgagtgcggccaccacgccttcagcgaccaccagcggctggacgacaccgtcggcctcatcttccactccttcctcctcgtcccttacttctcctggaacgacgccaccattccaacactggatccctcgagagagacgaagtgtttgtccccaagaagaagtcagacatcaagtggtacggcaagtacctcaacaacccgttgggacgcaccgtgatgttaacggttcagttcactctcgggtggcctttgtacttag

SEQ ID NO: 14463 - DNA, 318 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggcctcatcttccactccttcctcctcgtcccttacttctcctggagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14464 - DNA, 332 bp, Artificial
  Mutation in BnaA.FAD2.a introduced by TALE nuclease pair BnFAD2_T02
cctctcctccctcaccctctcccttacctcgcctggcccctctactgcgcctgccagggctgcgtcctaaccggcgtctgggtcatcgcccacgagtgcggccaccacgccttcagcgactaccagtggctggacgacaccgtcggcctcatcttccactccttcctcctcgtcccttacttctcctggaactggctccctcgagagagacgaagtgtttgtccccaagaagcagtcagacatcaagtggtacggcaagtgcctcagcagccgtttgggacgcaccgggatgttaacagttcaattcactctcggcgggccgtggtacttag

SEQ ID NO: 14465 - DNA, 365 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtacaaacagtcatcgacgccacaattccaacactggctccctcgagagagacgaagtgtttgtccccaagaagaagtcagacatcaagtggtacggcaagtacctcaacaaccctttgggacgaaccgtgatgttaacggttcagttcactctcggctggcctttgtacttag

SEQ ID NO: 14466 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggattcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14467 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctgtgggacgcaccgggatgttaacggttcagttcactctcggctgggccgttgtacttag

SEQ ID NO: 14468 - DNA, 344 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggacaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14469 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14470 - DNA, 385 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggcctcatcttccactccttcctcaagccgtgggcctggcacagcaccggcaacagccgctggaccgtctccagctgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14471 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctgtcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 14472 - DNA, 357 bp, Artificial
  Mutation in BnaA.FAD2.a introduced by TALE nuclease pair BnFAD2_T02
cctcttctccctcaccctgtctcctacttcgcctggcctctcccctgagcctgccagggctgcgtcctaaccggcgtctgggtcatagcccacgagtgcggccaccacgccttcagcgaccaccagtggctggacgacaccgtcggcctcctcttccactccttcctcctcgtcccttacttctcctggaaagtcatcgacgccaccattccaacactggctcccgcgagagagacgaagtgtttgtccccaagaagaagtcagacatcaagtggtacggcaagtacctcaacaacccttttggacgcaccgtggggttaacggttcggttcacgctcggccggcctttgtacttag

SEQ ID NO: 14473 - DNA, 359 bp, Artificial
  Mutation in BnaA.FAD2.a introduced by TALE nuclease pair BnFAD2_T02
cctctcctccctcaccctctcccctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacaaatcatcgacgccaccattccaacactggctccctcgagagagacgaagtgtttgtccccaagaagaagtcagacatcaagtggtacggcaagtacctcaacaaccctttgggacgcaccgtaatgttatcggttcagttcactctcggctggcctttgtacttag

SEQ ID NO: 14474 - DNA, 357 bp, Artificial
  Mutation in BnaA.FAD2.a introduced by TALE nuclease pair BnFAD2_T02
cctctcctccctcaccctctccattacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 14475 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgactaccagtggctggacgacaccgtcggcctcatcttccactccttcctcctcgtcccttacttctcctggaaatcatcgacgccaccattccaacactggctccctcgagagagacgaagtgtttgtcccaaagaagaagtcagacatcaagtggtacggcaagtacctcaacaaccctttgggacgcaccgtgatgttaacggttcagttcactctcggctggcctttgtacttag

SEQ ID NO: 14476 - DNA, 417 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacgtctccagcggctgttgccggtgctgtgccaggcccacggcttgacccaggagcaggtggtggccatcgccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14477 - DNA, 356 bp, Artificial
  Mutation in BnaA.FAD2.a introduced by TALE nuclease pair BnFAD2_T02
cctctcctccctcaccctctctactacttcgcctggcctctctactgcgcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcagttgtacttag

SEQ ID NO: 14478 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctaatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14479 - DNA, 441 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacaggtcgttcgctccaagctgggctgtgtgcacgaaccccccgttcagccttctacagcgcggagaatctcgctctctccacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtattag

SEQ ID NO: 14480 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14481 - DNA, 348 bp, Artificial
  Mutation in BnaA.FAD2.a introduced by TALE nuclease pair BnFAD2_T02
cctctcctccctcaccctctcccttacctcgcctaacccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttagtcatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggctggcctttgtacttag

SEQ ID NO: 14482 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcctctgggtcatcgcccacgaatgcggccaccacgccttcagcgaccaccagtggcttgacgacaccgtcggcctcatcttccactccttcctcctcgtcccttacttctcctggaagtagtcatcgacgccaccattccaacactggctccctcgagagagacgaagtgtttgtccccaagaagaagtcagacagcaagtggtacggcaagtacctcaacaaccctttgggacgcaccgtgatgttaaccgttcagttcacgctcggctggcctttgtacttag

SEQ ID NO: 14483 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacacccctgtgggacgcaccgtgatgttaacggttcagttcactctcggctggcctttgtactcag

SEQ ID NO: 14484 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14485 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaattcatcgacgccaccattccaacactggctccctcgagagagacgaagtgtttgtccccaagaagaagtcagacatcaagtggtatggcaagtacctcaacaaccctttgggacgcaccgtgatgttaacggttcagttcactctcggctggcctttgtacttag

SEQ ID NO: 14486 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 14487 - DNA, 353 bp, Artificial
  Mutation in BnaA.FAD2.a introduced by TALE nuclease pair BnFAD2_T02
cctctgctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcatgtgtacttag

SEQ ID NO: 14488 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14489 - DNA, 379 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcgtcttccactccttccactccttacttactcgtcccctacaacctgcccatcggccaggccgacgccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 14490 - DNA, 347 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcatcgacgccaccaatccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 14491 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcctctgggtcatcgcccacgaatgcggccaccacgccttcagcgaccaccagtggctggacgacgccgtgggcctcgtcttccactccttcctcctcgtcccttacttctcctggaagtaacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 14492 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacatcgacgccaccattccaacactggctccctcgagagagacgaagtgtttgtccccaagaagaagtcagacatcaagtggtacggcaagtaccgcaacaaccctttgggacgcaccgtgatgttaacggttcagttcactctcggctggcctttgtacttag

SEQ ID NO: 14493 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggcttcctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14494 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtcatcgacgccaccattccaacattggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14495 - DNA, 346 bp, Artificial
  Mutation in BnaA.FAD2.a introduced by TALE nuclease pair BnFAD2_T02
cctctcctccctcaccctgtctcctacttcgcctggcctctatcctaagcctgccaaggatgcgtcctaaccggcgtctgggtcatagcccacgagtgcggccaccacgccttcagcgactaccagtggctggacgacaccgtcggcctcatcttccactccttcctcctcgtcccttacttctcctggagccaccattccaacactggctccctcgagagagacgaagtgtttgtccccaagaagaagtcagacatcaagtggtacggcaagtacctcaacaacccgttgggacgcaccgtgatgttaacggttcagttcactctcggctagcctgtgtacttag

SEQ ID NO: 14496 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctgttcatcgacgccaccattccaacactggctccctcgagggagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14497 - DNA, 409 bp, Artificial
  Mutation in BnaA.FAD2.a introduced by TALE nuclease pair BnFAD2_T02
cctctcctccctcaccctctatcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagcaacagccgctggaccgtctccagcgcctgcttgccgccatcgtggctggcgagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14498 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacacagtcatcgacgccaccattccaacaccggatccctcgagagggatgaagtgttcgtccccaagaagaaatccgacatcaagtggtacggaaagtacctcaacaacccgctaggacgcacggggatgctaaccgtccatgtcacgcgcggctggcctttgtacttag

SEQ ID NO: 14499 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttacagtcatcgacgccaccattccaacactggctccctcgagagagacgaagtgtttgtccccaagaagaagtcagacatcaagtgatacggcaagtacctcaacaaccctgtgggacgcaccgtgatgttaacggttcagttcactctcggctggcctttgtacttag

SEQ ID NO: 14500 - DNA, 354 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14501 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgatgccaccattccaacactggctccctcgagagagacgaagtgtttgtccccaagaagaagtcacacatcaagtggtccggcaagtcccccaacacccctttgggacgcaccgtgatgttaacggttccgttcactctcggctggcctttgtacttag

SEQ ID NO: 14502 - DNA, 384 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagcaaatatttcttgtcaaaaatgctccaccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14503 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcacacatcaagtggtacggcaagtacctcaacaaccctttgggacgcaccgtgatgttaaccgttcagttcactctcggctggcctttgtacttag

SEQ ID NO: 14504 - DNA, 356 bp, Artificial
  Mutation in BnaA.FAD2.a introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 14505 - DNA, 323 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccgctcgccgcagccgaacgaccgagaagaagtcagacatcaagtggtacggcaagtacctcaacaaccctttgggacgcaccgtgatgttaacggttcagttcactctcggctggcctgtgtacttag

SEQ ID NO: 14506 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 14507 - DNA, 393 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgggcctggcacagcaccggcaacagccgctggacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14508 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaagtcacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 14509 - DNA, 321 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14510 - DNA, 350 bp, Artificial
  Mutation in BnaA.FAD2.a introduced by TALE nuclease pair BnFAD2_T02
cctctcctccctcaccctctccattacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14511 - DNA, 356 bp, Artificial
  Mutation in BnaA.FAD2.a introduced by TALE nuclease pair BnFAD2_T02
cctctcctccctcaccctctctcctacttcgcctggcatctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggctttgtacttag

SEQ ID NO: 14512 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccaggtcacgctcggctggcctttgtacttag

SEQ ID NO: 14513 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttggtacttag

SEQ ID NO: 14514 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctagtcatcgacgccaccattccaacactggctccctcgagagagacgaagtgtttgtccccaagaagaagtcagacatcaagtggtacggcaagtacctcaacaacccttttggacgcgccgtgatggtaacggttcagttcactctcggctggccgttgtacttag

SEQ ID NO: 14515 - DNA, 363 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcacacgaatgcggccaccacgccttcagcgaccaccagtggctggacgacgccgtgggcctcgtcttccactccttcctcctcgtcccttacttctcctggaagtatacagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 14516 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14517 - DNA, 355 bp, Artificial
  Mutation in BnaA.FAD2.a introduced by TALE nuclease pair BnFAD2_T02
cctctcctcctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14518 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatggtaacggttcagtccactctcggctggcctttgtacttag

SEQ ID NO: 14519 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggcgggcctttgtacttag

SEQ ID NO: 14520 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14521 - DNA, 330 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcatcgacgccaccattccaacactggctccctcgagagagacgaagtgtttgtccccaagaagaagtcagacatcaagtggtacggcaagtacctcaacaaccctttgggacgcaccgtgatgttaacggttcaattcactctcggctggcctttgtacttag

SEQ ID NO: 14522 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgtgacgcaccgtgatgttaacggttcagttcactctcggctggcctttgtacttag

SEQ ID NO: 14523 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14524 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 14525 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccagtagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 14526 - DNA, 411 bp, Artificial
  Mutation in BnaA.FAD2.a introduced by TALE nuclease pair BnFAD2_T02
cctctcctccctcaccctctcccttacctcgcctggcccctctactgtgcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggtggcaagcaggcgctggagacggtccagcggctgttgccggtgctgtgccaggcccagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 14527 - DNA, 341 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcgtcttccactccttcctcctcgtcccttacttctcctggaaattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 14528 - DNA, 348 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctccatcgacgccaccattccaacactggctccctcgagagggatggagtgttcgtccccaagaagaaatccgacatcaagtggtacggaaagtacctcaacaacccgctaggacgcacggtgatgctaaccgtccagttcacgctcggctggcctttgtacttag

SEQ ID NO: 14529 - DNA, 357 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccggtgggacgcaccgggaggttaacggttcagttcactctcggctggccgttgtacttag

SEQ ID NO: 14530 - DNA, 357 bp, Artificial
  Mutation in BnaA.FAD2.a introduced by TALE nuclease pair BnFAD2_T02
cctctcctccctcaccctctcacttacctcgcctggcatctctcctgggcctgccaagggtgcgtcctaacaggcgtctgggtcatagcccacgagtgcggccaccacgacatcagcgactaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttggaacgcaccgtgaggttaacggttcaggtcactctcggctggcctttgtacttag

SEQ ID NO: 14531 - DNA, 467 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtggaaagcgggcagtgagcgcaacgcaattaagctcgccgcgttgtttcatcaagccttacggtcaccgtaaccagcaaatcaatatcactgtgtggcttcaggccgccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14532 - DNA, 362 bp, Artificial
  Mutation in BnaA.FAD2.a introduced by TALE nuclease pair BnFAD2_T02
cctctcctcctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 14533 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtttttgtccccaagaagaagtcagacatcaagtggtacggcaagtacctcaacaaccctttgggacgcaccgtgatgttaacggttcagtgcactctcggctggcctttgtacttag

SEQ ID NO: 14534 - DNA, 360 bp, Artificial
  Mutation in BnaA.FAD2.a introduced by TALE nuclease pair BnFAD2_T02
cctctcctccctcaccctctctactacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagtcagccatcgacgccaccattccaacactggctccctcgagagagacgaagtgtttgtccccaagaagaagtcagacatcaagtggtacggcaagtacctcaacacccctttgggacgcaccgtgatgttaacggttcagttcactctcggctggcctttggacttag

SEQ ID NO: 14535 - DNA, 356 bp, Artificial
  Mutation in BnaA.FAD2.a introduced by TALE nuclease pair BnFAD2_T02
cctctcctccctcaccctctctcctacttctcctggcctctctactgggcctgccagggctgcgtcctaaccggcgtctgggacatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtcccgcaagtaccccacaacctctgaggggcgcaccgtgatgttaacggttccgttcactctcggctggcctttgtacttag

SEQ ID NO: 14536 - DNA, 354 bp, Artificial
  Mutation in BnaA.FAD2.a introduced by TALE nuclease pair BnFAD2_T02
cctctcctccctcaccctctatcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaacccttcgggacgcaccgtgatgttaaccgttcagttcactctcggctggcctttgtacttag

SEQ ID NO: 14537 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14538 - DNA, 433 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagcggcgagcggtatcagctcactcaaaggcggtaatacggttatccacagaatcaggggataacgcaggaaagaacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 14539 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14540 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctgtcatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 14541 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacaaatgcggccaccacgccttcagcgaccaccagtggctggacgacgccgtgggcctcgtcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggctggcctttgtacttag

SEQ ID NO: 14542 - DNA, 372 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttactcaagtcagaggtggcgaaacccgacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14543 - DNA, 349 bp, Artificial
  Mutation in BnaA.FAD2.a introduced by TALE nuclease pair BnFAD2_T02
cctcttctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14544 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 14545 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctagtcatcgacgccaccattccaacactggctcccacgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14546 - DNA, 358 bp, Artificial
  Mutation in BnaA.FAD2.a introduced by TALE nuclease pair BnFAD2_T02
cctctcctccctcaccctctctcctacttcgcctggcctctctactaggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 14547 - DNA, 356 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14548 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctgccctttgtacttag

SEQ ID NO: 14549 - DNA, 349 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggcctcatcttccactccttcctcctcgtcccttacttctcccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14550 - DNA, 355 bp, Artificial
  Mutation in BnaA.FAD2.a introduced by TALE nuclease pair BnFAD2_T02
cctcttctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14551 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 14552 - DNA, 351 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14553 - DNA, 409 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggagcaacagccgctggaccgtctccagcgcctgcttgccgccatcgtggctggcgagtcatcgacgccaccattccaacactggctccctcgagagagacgaagtgtttgtcgccaagaagaagtcagacatcaagtggtacggcaagtacctcaacaaccctttgggacgcaccgtgatgttaacggttcagttcactctcggctggcctttgtacttag

SEQ ID NO: 14554 - DNA, 357 bp, Artificial
  Mutation in BnaA.FAD2.a introduced by TALE nuclease pair BnFAD2_T02
cctctcctccctcaccctctaccttacctcgcctggcccctctactgggcctgccaaggctgcgtcctaacgggcctctgggtcatcgcccacgaatgcggccaccacgccttcagcgaccaccagtggctggacgacgccgtgggcctcgtcttcaactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14555 - DNA, 345 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcttcccttacttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 14556 - DNA, 332 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatattccactccttcctcctcgtcccttacttctcctggaactggctccctcgagagagacgaagtgttcgtccccaagaagaaatccgacatcaagtggtacggaaagtaccccaacaacccgctaggacgcacggtgatgctaaccgtccagttcacgctcggctggcctttgtacttag

SEQ ID NO: 14557 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccccgccttcagcgaccaccagtggctggacgacgccttgggcctcgtcttccactccttcctcctcgtcccttacttctccttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagtttactctcggctggcctttgtacttat

SEQ ID NO: 14558 - DNA, 357 bp, Artificial
  Mutation in BnaA.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14559 - DNA, 356 bp, Artificial
  Mutation in BnaA.FAD2.a introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14560 - DNA, 356 bp, Artificial
  Mutation in BnaA.FAD2.a introduced by TALE nuclease pair BnFAD2_T02
cctctcctccctcaccctctctactacttcgcctggcctctctactgggcctgccaagggtgcgtcctaaccggcgtctgggtcatagcccacgaatgcggccaccacgccttcagcgaccaccagtggctggacgacgccgtgggcctcgtcttccactccttcctcctcgtcccttacttctcctggatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14561 - DNA, 336 bp, Artificial
  Mutation in BnaA.FAD2.a introduced by TALE nuclease pair BnFAD2_T02
cctctcctccctcaccctctctactacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14562 - DNA, 358 bp, Artificial
  Mutation in BnaA.FAD2.a introduced by TALE nuclease pair BnFAD2_T02
cctctcctccctcgccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14563 - DNA, 358 bp, Artificial
  Mutation in BnaA.FAD2.a introduced by TALE nuclease pair BnFAD2_T02
cctctcctccatcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 14564 - DNA, 352 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 14565 - DNA, 354 bp, Artificial
  Mutation in BnaA.FAD2.a introduced by TALE nuclease pair BnFAD2_T02
ccttcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14566 - DNA, 391 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttctcctggaagtacgatgttccagattacgctatcgatatcgccggccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 14567 - DNA, 310 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 14568 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgaccaccagtggctggacgacgccgtgggcctcgtcttccactccttcctcctcgtcccttacttctcctcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 14569 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcatcgtcccttacttctcctgtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14570 - DNA, 312 bp, Artificial
  Mutation in BnaA.FAD2.a introduced by TALE nuclease pair BnFAD2_T02
cctctcctccctcaccctctctcctacttcgcctggcctctctactgcgcctgccagggctgcgtcctaaccggcgtctgggtcatagcccacgagtgcggccaccacgccttcagcgactaccagtggctggacgacaccgtcggcctcatcgacgccaccattccaacactggctccctcgagagagacgaagtgtttgtccccaagaagaagtcagacatcaagtggtacggcaagtacctcaacaacccgtggggacgcaccgtgatgttaacggttcaggtcactcttggctgccctgtacacttag

SEQ ID NO: 14571 - DNA, 355 bp, Artificial
  Mutation in BnaA.FAD2.a introduced by TALE nuclease pair BnFAD2_T02
cctctcctccctcaccctctctcctacttcgcctggcctctctactgagcctgccagggctgcgtcctaaccggcgtctgggtcatagcccacgagtgcggccaccacgccttcagcgactaccagtggctggacgacaccgtcggcctcatcttccactccttcctcctcgtcccttacttctccagtagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 14572 - DNA, 359 bp, Artificial
  Mutation in BnaA.FAD2.a introduced by TALE nuclease pair BnFAD2_T02
cctctcctccctcacccttcctcctacttcgcctggccgctgtactgggcctgacaaggctgcgtcctaacgggcctctgggtcaccgcccacgaatgcggccaccaagccttcagcgactaccagagggtcgacgacaccgtcggactcatcttccactccttcctcctcgtcccttacttctcctggaagtagtcatcgacgccaccattcctacactggctccctcgagagagacgaagtgtttgtccccaagaagaagtcagacatcaagtggtacggcaagttcctcaactcccctttgggatgcacctttatgttaatggttcaggtcactgttggctctccgttgggcttag

SEQ ID NO: 14573 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 14574 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttatcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14575 - DNA, 357 bp, Artificial
  Mutation in BnaA.FAD2.a introduced by TALE nuclease pair BnFAD2_T02
cctctgctccctcaccctctcccttacctcgcctggccactctactgggcctgccaaggctgcgtcctaacgggcctctgggtcatcgcccacgaatgcggccaccacgccttcagcgaccaccagtggctggactacgccgttggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggccagtatacttag

SEQ ID NO: 14576 - DNA, 363 bp, Artificial
  Mutation in BnaA.FAD2.a introduced by TALE nuclease pair BnFAD2_T02
cctctcctccctcaccctctctcctacttcgcctggcctctctactgtgcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 14577 - DNA, 357 bp, Artificial
  Mutation in BnaA.FAD2.a introduced by TALE nuclease pair BnFAD2_T02
cctctcctccctcaccctctctcctacttcgcctggcctctctcctgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccgttgggacgcaccgtgatgttaacggttcaggtcacgctcggctggcctttgcacttag

SEQ ID NO: 14578 - DNA, 366 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtacaatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14579 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggacatcgacgccaccattccaacactggctccctcgagagagacgaagtgtttgtccccaagaagaagtcagacatcaagtggtacggcaattacctcaacagccctttgggacgcaccgtgatgttaacggttcagttcactctcggctggcctttgtacttag

SEQ ID NO: 14580 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctgtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 14581 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14582 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaggggtgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14583 - DNA, 358 bp, Artificial
  Mutation in BnaA.FAD2.a introduced by TALE nuclease pair BnFAD2_T02
cctctcctccctcaccctctctcctacttcgcctggcatctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14584 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcccggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14585 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaccatgacgccaccattccaacaccggatccctcgatagggacgaagtgttcgtccccaagaagaaatccgacatcaagtggtacggcaagtacctcaacaacccgctaggacgcacggtgatgctaaccgtccagttcaagctcggctggcctttgtacttag

SEQ ID NO: 14586 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 14587 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggaaagtacctcaacagccagctaagacgcgcgttaatgctagccgtccagtgcgcgctcggctggccgttttacttag

SEQ ID NO: 14588 - DNA, 356 bp, Artificial
  Mutation in BnaA.FAD2.a introduced by TALE nuclease pair BnFAD2_T02
cctctcctccctcaccctctctactacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaaccctggctccctcgagagggatgaagtgttcgtccccaagaagaagtcagacatcaagtggtacgacaagtacctcaacagccctgtgggacgcaccgtgggggtaacggttcagttcgcgctcggcggggctgtgtacggag

SEQ ID NO: 14589 - DNA, 416 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccctcagcgactaccagtggctggacgacaccgtcggcctcatcttccactccttcctcctcgtcccttacttctcctggaagtccagcggctgttgccggtgctgtgccaggcccacggcttgaccccccagcaggtggtagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 14590 - DNA, 357 bp, Artificial
  Mutation in BnaA.FAD2.a introduced by TALE nuclease pair BnFAD2_T02
cctctcctccctcaccctctctcctacttcgcctggcatctctcctgagcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaagcctctgggacgcactgtgaggttaacggttcagttcacgctcggccggcctgtgcacttag

SEQ ID NO: 14591 - DNA, 358 bp, Artificial
  Mutation in BnaA.FAD2.a introduced by TALE nuclease pair BnFAD2_T02
cctctctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14592 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 14593 - DNA, 357 bp, Artificial
  Mutation in BnaA.FAD2.a introduced by TALE nuclease pair BnFAD2_T02
cctctcctccctcaccctctcccttacctggcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctgtgggacgcaccgtgatgttaaccgttcagttcactctcggctggcctttgtacttag

SEQ ID NO: 14594 - DNA, 384 bp, Artificial
  Mutation in BnaA.FAD2.a introduced by TALE nuclease pair BnFAD2_T02
cctcttctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctgcaatggcggtggcaagcaggcgctggagacggtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 14595 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 14596 - DNA, 312 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggccattgtacttag

SEQ ID NO: 14597 - DNA, 353 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14598 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14599 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcactctcggctggcctttgtacttag

SEQ ID NO: 14600 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgagtgcggccaccacgccttcagcgactaccagtggcttgacgacaccgtcggtctcatcttccactccttcctcctcgtcccttacttctcctggcatcgacgccaccattccaacactggctccctcgagagagacgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 14601 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14602 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14603 - DNA, 344 bp, Artificial
  Mutation in BnaA.FAD2.a introduced by TALE nuclease pair BnFAD2_T02
cctctcctccctcaccctctcccctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14604 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcccggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14605 - DNA, 448 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtactccagcgcctgcttgccgccatcgtggctggcgatggccaccacctgctccggggtcaagccgtgggcctggcacagcaccggcaacagtcattgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14606 - DNA, 357 bp, Artificial
  Mutation in BnaA.FAD2.a introduced by TALE nuclease pair BnFAD2_T02
cctctcctccctcaccctctccattacctcgcctggcccctctactgggcctgccaaggctgcgtcctaacgggcctcggggtcatcgcccacgaatgcggccaccacgccttcagcgaccaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtaaggcaagtacctcaacaaccctttgggacgcaccgtgatgttaacggttcagttcactctcggctggcctttgtacttag

SEQ ID NO: 14607 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaagtagtcatcgacgccaccattcaaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14608 - DNA, 363 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgctcacgaatgcggccaccacgccttcagcgaccaccagtggctggacgacaccgtcggcctcgtcttccactccttcctcctcgtcccttacttctcctggaagtatacagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 14609 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcagcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14610 - DNA, 354 bp, Artificial
  Mutation in BnaA.FAD2.a introduced by TALE nuclease pair BnFAD2_T02
cctctcctcctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14611 - DNA, 382 bp, Artificial
  Mutation in BnaA.FAD2.a introduced by TALE nuclease pair BnFAD2_T02
cctctcctccctcaccctctctactacttcgcctggcctctctactgggcctgccaagggtgcgtcctaaccggcgtctgggtcatagcccacgagtgcggccaccacgccttcagcgactaccagtggctggacgacaccgtcggcctgggtcaagttgagcggggcacccgtcagtgcattgcgccatgcaggcggcaagcaggcgctggagacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14612 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14613 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatgtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 14614 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcctctgggtcatcgcccacgaatgcggccaccacgccttcagcgaccaccagtggctggacgacgccgtgggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14615 - DNA, 350 bp, Artificial
  Mutation in BnaA.FAD2.a introduced by TALE nuclease pair BnFAD2_T02
cctctcctccctcaccctctctactacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctcatcgacgccaccattccaacactggctccctcgagagagacgaagtgtttgtccccaagaagaagtcagacatcaagtggtccggcaagtacctcaacacccctttgggacgcaccgtgatgttaacggttcagttcactctcggctggccgttgtacttag

SEQ ID NO: 14616 - DNA, 356 bp, Artificial
  Mutation in BnaA.FAD2.a introduced by TALE nuclease pair BnFAD2_T02
cctctcctccctcaccctctcccttacctcgcctggcacctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14617 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtatggcaagtacctcaacaaccctttgggacgcaccgtgatgttaacggttcagttcactctcggctggcctttgtacttag

SEQ ID NO: 14618 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatagctcacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14619 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcattttccactccttcctcctcgtcccttacttctcctggaacagtcatcgacgccaccattccaacaccggatccctcgagagggatgaagtgttcgtccccaagaagaaatccgacatcaagtggtacggaaagtacctcaacaacccgctaggacgcgcggtgatgctaaccgtccagttcacgctcggctggcctttgtacttag

SEQ ID NO: 14620 - DNA, 357 bp, Artificial
  Mutation in BnaA.FAD2.a introduced by TALE nuclease pair BnFAD2_T02
cctctcctccctcaccctatcccttacctcgcctggcccctctactgagcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacatccctttggaacgcactgtggtgttaacggttcagttcactctcggccggcctttgtacttag

SEQ ID NO: 14621 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtctgacatcaagtggtacggcaagtacctcaacaaccctttgggacgcaccgtgatgttaacggttcagttcactctcggctggcctttgtacttag

SEQ ID NO: 14622 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 14623 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14624 - DNA, 433 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgactaccagtggctggacgacaccgtcggcctcatcttccactccttcctcctcgtcccttacttctcctggaagcggcgagcggtatcagctcactcaaaggcggtaatacggttatccacagaatcaggggataacgcaggaaagaacagtcatcgacgccaccattccaacactggctccctcgagagagaagaagtgtttgtccccaagaagaagtcagacatcaagtggtacggcaagtacctcaacaacccgctaggacgcacggtgaggctaaccgtccagttcacgctcggctggcctttgtacttag

SEQ ID NO: 14625 - DNA, 360 bp, Artificial
  Mutation in BnaA.FAD2.a introduced by TALE nuclease pair BnFAD2_T02
cctctcctccctcaccctctctactacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14626 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggcttgacgacaccgtcggtctcatcttccactccttcctcctcgtcccttacttctcctggaagtcatcgacgccaccattccaacactggctccctcgagagggatgaagtgtttgtccccaagaagaagtcagacatcaagtggtacggcaagtacctcaacaaccctttgggacgcaccgtgatgttaacggttcagttcactctctgctggcctttgtacttag

SEQ ID NO: 14627 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcacacgagtgcggccaccacgccttcagcgactaccagtggcttgacgacaccgtcggtctcatcttccactccttcctcctcgtcccttaatcgtgtcatcgacgccaccattccaacactggctccctcgagagggatgaagtgttcgtccccaagaagaaatccgacatcaagtggtacggaaattacctgaacaccccggtaggacgcacggtgaagccaaccctccagttcacgctcggctggcctttgtacttag

SEQ ID NO: 14628 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaattcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 14629 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14630 - DNA, 406 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtactccagcgcctgcttgccaccattattgctggcgatggccaccacctgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctctgctggcctttgtacttag

SEQ ID NO: 14631 - DNA, 356 bp, Artificial
  Mutation in BnaA.FAD2.a introduced by TALE nuclease pair BnFAD2_T02
cctctcctccctcaccctctctactacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 14632 - DNA, 355 bp, Artificial
  Mutation in BnaA.FAD2.a introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14633 - DNA, 352 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcgaccaccacgccttcagcgaccaccagtggctggacgacgccgtgggcctcgtcttccactccttcctcctcgtcccttacttctccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcgctctcggctggcctttgtacttag

SEQ ID NO: 14634 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttggtacgcaccgtgatgttaacggttcagttcactctcggctggcctttgtacttag

SEQ ID NO: 14635 - DNA, 349 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgtcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14636 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 14637 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgatgccaccattccaacactggctccctcgagagagacgaagtgtttgtccccaagaagaagtcagacatcaagtggtacggcaagtacctcaacaaccctttgggacgcaccgtgatgttaacggttcagttccctctcggctggcctttgtacttag

SEQ ID NO: 14638 - DNA, 364 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagtgaccaccagtggctggacgacgccgtgggcctcctcttccactccttcctcctcgtcccttacttctcctggaagttacacagtcatcgacgccaccattccaacactggctccctcgagagagacgaagtgtttgtccccaagaagaagtcagacatcaagtggtacggcaagtacctcaacaacccgctgggacgcaccgtgatgctaacggttcagttcactctcggctggcctttgtacttag

SEQ ID NO: 14639 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 14640 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 14641 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcctcttccactccttcctcctcgtcccttacttctccgggaagtcatcgacgccaccattccaacactggctccctcgagagagacgaagtgtttgtccccaagaagaagtcagacatcaagtggtacggcaagtacctcaacaaccctgtgggaagcaccgtgaggttaacggttcagttcactctcggctggccttggtacgtag

SEQ ID NO: 14642 - DNA, 391 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcatcttccactccttccaccaccagcaatattggtggcaagcaggcgctggagacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 14643 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctctgggacgcaccgtgatgttaacggttcagttcactctcggctggcctttgtacttag

SEQ ID NO: 14644 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctgtcatcgacgccaccattccaacactggctccctcgagagagacgaagtgtttgtccccaagaagaaatccgacatcaagtggtacggaaagtacctcaacaacccgttaggacgcgcggtgatgctaaccgtccagttcacgcccggctggcctttgtccttag

SEQ ID NO: 14645 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtcatcgacgccatcattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14646 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 14647 - DNA, 416 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtacacaggccaacttctcaagattgcaaaacgtggcggcgtgaccgcagtggaggtacagtcatcgacgccaccattccaacactggctccctcgagagagacgaagtgtttgtccccaagaagaagacagacatcaagtggtacggcaagtacctcaacaaccctttgggacgcaccgtgatgttaacggttcagttcactctcggctggcctttgtacttag

SEQ ID NO: 14648 - DNA, 358 bp, Artificial
  Mutation in BnaA.FAD2.a introduced by TALE nuclease pair BnFAD2_T02
cctctgctccctcaccctctctcctacttcgcctggcctctctcccgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcccggaagagtcatcgacgccaccattccaacactggctccctcgagagagacgaagtgtttgtccccaagaagaagtcagacatcaagtggtacggcgagtacctcaacaaccctttgtgacgcagcgtgaggttaacggttcagttcagtctccgccggcctttgcacttag

SEQ ID NO: 14649 - DNA, 414 bp, Artificial
  Mutation in BnaA.FAD2.a introduced by TALE nuclease pair BnFAD2_T02
cctctcctccctcaccctctctcctacttcgccttgcctctctcctgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggagaccccccagcaggtggtggccatcgccagcaataatggtggcaagcaggcgctggagagtcatcgacgccaccattccaacaccggctccctcgagagagacggagtgtttgtccccaagaagaagtcagacatcaagtggtacggcaagtacctcaacaaccctttgggacgcaccgtgatgttaacggttcagttcactctcggctggcctttgtacttag

SEQ ID NO: 14650 - DNA, 356 bp, Artificial
  Mutation in BnaA.FAD2.a introduced by TALE nuclease pair BnFAD2_T02
cctctcctccctcaccctctcccttacctcgcctggcccctccactgagcctgccaaggctgcgtcctaaccggcgtctgggtcatagcccacgagtgcggccaccacgccttcagcgactaccagtggctggacgacaccgtcggcctcatcttccactcctccctcctcgtcccttacttctcctggaaatcatcgacgccaccattccaacactggctccctcgagagagacgaagtgtttgtccccaagaagaagtcagacatcaagtggtacggcaagtacctcaacaacccttttggacgcaccgtgatgttaacggttcaggtgactctcgtctggccgttgtgcttag

SEQ ID NO: 14651 - DNA, 356 bp, Artificial
  Mutation in BnaA.FAD2.a introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgatagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14652 - DNA, 350 bp, Artificial
  Mutation in BnaA.FAD2.a introduced by TALE nuclease pair BnFAD2_T02
cctctcctccctcaccctctccattacctcgccttgcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14653 - DNA, 466 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacagcgacggtccctaacgctgccgggtgttggcttaaggcttgatgaaacaacgcggcgaggcccacggcttgaccccggagcaggtggtggccatcgccagccacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14654 - DNA, 379 bp, Artificial
  Mutation in BnaA.FAD2.a introduced by TALE nuclease pair BnFAD2_T02
cctctcctccctcaccctctctactacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggtcgttcggctgcggcgagcggtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14655 - DNA, 358 bp, Artificial
  Mutation in BnaA.FAD2.a introduced by TALE nuclease pair BnFAD2_T02
cctctactccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcacagtgatgttaacggttcagttcactctcggcttgcctttgtacttag

SEQ ID NO: 14656 - DNA, 312 bp, Artificial
  Mutation in BnaA.FAD2.a introduced by TALE nuclease pair BnFAD2_T02
cctctcctccctcaccctctctcctacctcgcctggcccctctactgggcctgccaaggctgcgtcctaacgggcctctgggtcatcgcccacgaatgcggccaccacgccttcagcgaccaccagtggctggacgacgccgtgggcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14657 - DNA, 357 bp, Artificial
  Mutation in BnaA.FAD2.a introduced by TALE nuclease pair BnFAD2_T02
cctctcctccctcaccctatctcctacttcgcctggcctctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctctgggacgccccgtgatgttaacggttcagttcactctcggctggcctttgtacttag

SEQ ID NO: 14658 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagggatgaagtgttcgtccccaagaagaaatccgacatcaagtggtacggaaagtccctcaacaccccggtaggacgcacggtgatgctaaccgtccagttcacgctcggctggcctttgtacttag

SEQ ID NO: 14659 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 14660 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacgccgtgggcctcgtcttccactccttcctcctcgtcccttacttctcctggaagtacacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14661 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccagggctgcgccctaaccggcgtctgggtcatagcccacgagtgcggccaccacgccttcagcgactaccagtggctggacgacaccgtcggcctcatcttccactccttcctcctcgtcccttacttctagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 14662 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtctgtcaactacctcaacaaccgtttgggacgaaacgtggccttaccggctcagtccactctcggctggcctttgtacttag

SEQ ID NO: 14663 - DNA, 329 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactaccagtcatcgacgccaccattccaacactggctccctcgagagagacgaagtgtttgtccccaagaagaagtcagacatcaagtggtacggcaagtacctcaacaacccttcgggacgccccgtgatgttaacggttcagttcactctcggctggcctttgtacttag

SEQ ID NO: 14664 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactgccagtggctggacgacaccgtcggcctcatcttccactccttcctcctcgtcccttacttctccttgtcatcgacgccaccattccaacactggctccctcgagagagacgaagtgtttgtccccaagaagaagtcagacatcaagtggtacagaaagtacctcaacaacccgctgtgacgcacggtgatgctaaccgtccagttcacgctcggctggcctttgtactgag

SEQ ID NO: 14665 - DNA, 353 bp, Artificial
  Mutation in BnaA.FAD2.a introduced by TALE nuclease pair BnFAD2_T02
cctctcctccctcaccctatcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14666 - DNA, 358 bp, Artificial
  Mutation in BnaA.FAD2.a introduced by TALE nuclease pair BnFAD2_T02
cctctcctccctcaccctctctactacttcgcctggcccctctactgggcctgacagggctgcgtcctaaccggcgtctgggtaatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 14667 - DNA, 339 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccaccatttcaacactggcttcctcgagagagacgaagtgtttgtccccaagaagaagtcagacatcaagtggtacggcaagtacctcaacaaccctttgggacgcaccgtgatgttaacggttcagttcactctcggctagcctttgtacttag

SEQ ID NO: 14668 - DNA, 294 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctccttgtcaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 14669 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14670 - DNA, 345 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttcttcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14671 - DNA, 383 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtctccagcgcctgcttgccaccgccagtcatcgacgccaccattccaacactggctccctcgagagagacgaagtgtttgtccccaagaagaagtcagacatcaagtggtacggcaagtacctcaacacccctgtgggacgcaccgtgatgttaacggttcagttcactctcggctggcctgtgtacttag

SEQ ID NO: 14672 - DNA, 389 bp, Artificial
  Mutation in BnaA.FAD2.a introduced by TALE nuclease pair BnFAD2_T02
cctctcctccctcaccctctcccttacctcgccttgcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggatctcaggaagatcctttgatcttttctacagtcatcgacgccaccattccaacactgactccctcgaaagagacgaagtgtttgtccccaagaagaagtcaaacatcaagtagtgcggcaagtaccgcagcaaacctgtgggaagcaccgtgatgttaacggttcagttcactcgcggctggccttggtacttag

SEQ ID NO: 14673 - DNA, 367 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtgggcctcgtcttccactccttcctcctcgtcccttacttctcctggaagtacacacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14674 - DNA, 332 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 14675 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 14676 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 14677 - DNA, 433 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccgtctttgaacgttgtgatggccaccaatggcggcggctgttgccggtgctgtgccaggcccacggcttgacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14678 - DNA, 362 bp, Artificial
  Mutation in BnaA.FAD2.a introduced by TALE nuclease pair BnFAD2_T02
cctctcctccctcaccctatcacttacctcgcctggcacctctcctgagcctgccaaggctgcgtcctaacgggcctctgggtcatcgcccacgaatgcggccaccacgccttcagcgactaccagtggctggacgacgccgtcggcctcctcttccactccttcctcctcgtcccttacttctcctggaagttacagtcatcgacgccaccattccaacactggctccctcgagagagacgaagtgtttgtccccaagaagaagtcagacatcgagtggtacggcaagtacctcaacaaccctttgggacgcaccgtgatgttaacggttcagttcactctcggctggcctttgcacttag

SEQ ID NO: 14679 - DNA, 356 bp, Artificial
  Mutation in BnaA.FAD2.a introduced by TALE nuclease pair BnFAD2_T02
cctctcctccctcaccctctctcctacttcgcctggcctctctactgggcctccacgggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccatgccaacactggctccctcgagagagacgaagtgtttgtccccaagaagaagtaagacatcaagtggtccgacaagtacctcaacagcctcttgggacgcgccgtgagggtaacaggtcagttttctctcggttggcctttgtacgtaa

SEQ ID NO: 14680 - DNA, 357 bp, Artificial
  Mutation in BnaA.FAD2.a introduced by TALE nuclease pair BnFAD2_T02
cctctcctccctcaccctctctcctacttcgcctggcatctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaatgtcatcgacgccaccattccaacactggctccctcgagagagacgaagtgtttgtccccaagaagaagtcagccatcaagtggtacggcaggtgcctctacaacccgttggaacgcaccgggatgttaacggttcagttcactttcggctggcctttgtacttag

SEQ ID NO: 14681 - DNA, 345 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggagccaccattccaacactggctccctcgagacagacgaagtgtttgtccccaagaagaagtcagacatcaagtggtacggcaagtacctcaacaaccctttgggacgcaccgtgatgttaacggttcagttcactctcggctggcctttgtactag

SEQ ID NO: 14682 - DNA, 357 bp, Artificial
  Mutation in BnaA.FAD2.a introduced by TALE nuclease pair BnFAD2_T02
cctctcctccctcaccctctcacttacctcgcctggcccctctactgggcctgccaaggctgcgtcctaaccggcctctgggtcatcgcccacgaatgcggccaccacgccttcagcgaccaccagtggctggacgactccgtcggcctcgtcttccactccttcctcctcgtcccttacttctcctgtaaagccatcgacgccaccattccaacaccggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14683 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 14684 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaagtacacagtcatcgacgccaccattccaacactgactccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14685 - DNA, 466 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacagcgacggtccctaacgctgccgggtgttggcttaaggcttgatgaaacaacgcggcgaggcccacggcttgcccccggagcaggtggtggccatcgccagccacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14686 - DNA, 360 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaagtaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 14687 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 14688 - DNA, 465 bp, Artificial
  Mutation in BnaA.FAD2.a introduced by TALE nuclease pair BnFAD2_T02
cctctcctccctcaccctctctcctacttcgcctggcctctctactgggcctgccaatggtgcgtcctaacgggcctctgggtcatcgcccacgaatgcggccaccacgccttcagcgaccaccagtggctggacgacgccgtgggcctcgtcttccactccttcctcctcgtcccttacttctcctggaagtacggaccgtctccagcgcctgcttgccgccatcgtggctggcgatggccaccacctgcgggggggtcaagccgttggcctgccacagcaccggcaacagccgctggacacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14689 - DNA, 335 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttactcaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14690 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgaatgcggccaccacgccttcagcgaccaccagtggctggacgacgccgtgggcctcgtcttccactccttcctcctcgtcccttacttctcctggaacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 14691 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggatgtcatcgacgccaccattccaacactggctccctcgagagagacgaagtgtttgtccccaagaagaagtcagacatcaagtggtacggcaagtacctcaacaaccatgtgggacgcaccgtgatgttaacggttcagttcactctcggctggcctttgtacttag

SEQ ID NO: 14692 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgaccaccagtggctggacgacgccgtgggcctcgtcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14693 - DNA, 356 bp, Artificial
  Mutation in BnaA.FAD2.a introduced by TALE nuclease pair BnFAD2_T02
cctctcctccctcaccctatctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14694 - DNA, 348 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14695 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14696 - DNA, 357 bp, Artificial
  Mutation in BnaA.FAD2.a introduced by TALE nuclease pair BnFAD2_T02
cctctcctccctcaccctctctcctacttcgcctggcccctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaaggaccgcaacaaccctttgggacgcaccgtgatgttaacgggtcagttcactctcggctgtccgttggacttag

SEQ ID NO: 14697 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccactccttcagcgaccaccagtggctggacgacgccgtgggcctcgtcttccactccttcctcctcgtcccttacttctcctggaaagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14698 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacatccctttgggacgcaccgtgatgttaacggttcagttcactctcggctggcctttgtacttag

SEQ ID NO: 14699 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacgtttcagttcactctcggctggcctttgtacttag

SEQ ID NO: 14700 - DNA, 340 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcttccatcgacgccaccattccaacaccggatccctcgagagggatgaagtgttcgtccccaagaagaaatccgacatcaagtggtacggcaagtacctcaacacccctttgggacgcaccgtgatgttaacggttcagttcactctcggctggcctttgtacttag

SEQ ID NO: 14701 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctgtcatcgacgccaccattccaacactggctccctcgagagagacgaagtgtttgtccccaagaagaagtcagacatcaagtggtacggcaagtacctcaacaaccctttgggacgcaccgtgatgtcaaccgttcagttcactctcggctggcctttgtacttag

SEQ ID NO: 14702 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacaccggatccctcgagagggatgaagtgttcgtccccaagaagaaatccgacatcaagtggtacggcaagtacctcaacatgcctttgggacgcaccgtgatgttaacggttcagttcactctcggctggcctttgtacttag

SEQ ID NO: 14703 - DNA, 359 bp, Artificial
  Mutation in BnaA.FAD2.a introduced by TALE nuclease pair BnFAD2_T02
catctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14704 - DNA, 319 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttccaccattccaacactggctccctcgagagggatgaagtgttcgtccccaagaagaaatccgacatcaagtggtacagaaagtacctcaacaacccgctaggacgcacggtgatgctaaccgtccagttcacgctcggctggcctttgtacttag

SEQ ID NO: 14705 - DNA, 421 bp, Artificial
  Mutation in BnaA.FAD2.a introduced by TALE nuclease pair BnFAD2_T02
cctctcctcctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagtacggcttgaccccggagcaggtggtggccatcgccagccacgatggcggcaagcaggcgctggagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 14706 - DNA, 389 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtctggcgccgtcgggcttcctggagccgcccagccatcgacgccaccattccaacaccggatccctcgagagagacgaagtgtttgtccccaagaagaagtcagacatcaagtggtacggcaagtacctcaacaaccctttggtacgcaccgtgatgttaacggttcagttcactctcggctggcctttgtacttag

SEQ ID NO: 14707 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 14708 - DNA, 324 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgccaacgaatgcggccaccacgccttcagcgaccaccagtggctggacgacgccgtgggcctcgtcttccactccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14709 - DNA, 365 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttcctcctcgtcccttacttctcatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14710 - DNA, 330 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14711 - DNA, 362 bp, Artificial
  Mutation in BnaA.FAD2.a introduced by TALE nuclease pair BnFAD2_T02
cctctcctccctcaccctctcccttacctcgcctggcccctctaatgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaaaagccatcgacgccaccattccaacactggctccctcgagagagacgaagtgtttgtccccaagaagaagtcagacatcaagtggtacggcaaggacctcaacaaccctttgggacgcaccgtgatgttaacggttcagttcactctcggctggcctttgtacttag

SEQ ID NO: 14712 - DNA, 343 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttcctcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggctttgtacttag

SEQ ID NO: 14713 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 14714 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaatgtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 14715 - DNA, 355 bp, Artificial
  Mutation in BnaA.FAD2.a introduced by TALE nuclease pair BnFAD2_T02
cctcttctccctcaccctctctcctactttgcctggcctctctactgggcctgccagggctgcgtcataaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14716 - DNA, 335 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaacgggcctctgggtcatcgcccacgaatgcggccaccacgccttcagcgaccaccagtggctggacgacgccgtcggcctcatcttccactccttcctcctcgtcccttactcaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14717 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 14718 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14719 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgaccaccagtggctggacgacgccgtgggcctcgtcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14720 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaatcgacgccaccattccaacactggctccctcgagagagacgaagtgtttgtcaccaagaagaagtcagacatcaagtggtacggcaagtacctcaacaaccctttgggacgcaccgtgatgttaacggttcagttcactctcggctggcctttgtacttag

SEQ ID NO: 14721 - DNA, 355 bp, Artificial
  Mutation in BnaA.FAD2.a introduced by TALE nuclease pair BnFAD2_T02
cctctcctccctcaccctctctcctacttcgcctggcctctctactcggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 14722 - DNA, 348 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaacgccaccattccaacactggctccctcgagagagacgaagtgtttgtccccaagaagaagtcagacatcaagtggtacggcaagtacctcaacaaccctttgggacgcaccgtgatgttaacggttcagttctctctcggctggccgttgtacttag

SEQ ID NO: 14723 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 14724 - DNA, 349 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14725 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccatcctcctcgtcccttacttctcctggaagatcatcgacgccaccattccaacactggctccctcgagagagacgaagtgtttgtccccaataagaggtcaggcatcaagtgatacggcaagtacctcatcggctaggagagacggtccgggatgttatcgggtgagttgacgctcttgtctacgttgggcttag

SEQ ID NO: 14726 - DNA, 415 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtacatctcaactctcccgccaccgtgagcaaggcctccagagcgcgtgcgccggaccagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 14727 - DNA, 426 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacacacgcgcacatcgttgcgttaagccaacacccggcagcgttagggaccgtcgctgtcaagtatcagtcagcgacgccaccattccaacactggctccctcgagagagacgaagtgtttgtccccaagaagaagtcagacatcaagtggtacggcaagtacctcaacagcccgttgggacgcaccgtgatgttaacggttcagttcactctcggctggcatttgtacttag

SEQ ID NO: 14728 - DNA, 358 bp, Artificial
  Mutation in BnaA.FAD2.a introduced by TALE nuclease pair BnFAD2_T02
cctctcctccctcaccctctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14729 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14730 - DNA, 364 bp, Artificial
  Mutation in BnaA.FAD2.a introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacaaacagtcatcgacgccaccattccaacactggctccctcgagagagacgaagtgtttgtccccaagaagaagtcagacaacaagtggtacggcaagtacctcaacaaccctttgggacgcaccgtgatgttaacggttcagttcactctcggctggcctttgtactag

SEQ ID NO: 14731 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 14732 - DNA, 394 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccgctcgccatgcatgcactgcctccactgcggtagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 14733 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 14734 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgcgacgcaccgtgatgttaacggttcagttcactctcggctggcctttgtacttag

SEQ ID NO: 14735 - DNA, 352 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 14736 - DNA, 348 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14737 - DNA, 354 bp, Artificial
  Mutation in BnaA.FAD2.a introduced by TALE nuclease pair BnFAD2_T02
cctctcctccctcaccctctctcctacttcgcatggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 14738 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggccgttgtacttag

SEQ ID NO: 14739 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcagctggcctttgtacttag

SEQ ID NO: 14740 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttcctctccttcctcctcgtcccttacttctcctggaagttcatcgacgccaccattccaacactggctccctcgagagagacgaagtgtttgtccccaagaagaagtcacacatcaagtggtacggcaagtacctcaacaaccctttgggccgccccgtgatgttaaccgttcagttcactctcggctggcctttgtacttag

SEQ ID NO: 14741 - DNA, 413 bp, Artificial
  Mutation in BnaA.FAD2.a introduced by TALE nuclease pair BnFAD2_T02
cctctcctccctcaccctctcccttacctcgcctggcccctctaatgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacaggcccacggcttgaccccccagcacgtggtggccatcgccagcaatggcggtggcagccagcgacgccaccattccaacactggctccctcgagagagacgaagtgtttgtccccaagaagaaggcagacatcaagtggtacggcaaggacctcaacaacccgttgggacgcaccgtgatgttaacggttcagttcactctcgggtggccgttgtacttag

SEQ ID NO: 14742 - DNA, 353 bp, Artificial
  Mutation in BnaA.FAD2.a introduced by TALE nuclease pair BnFAD2_T02
cctctcctccctcaccctctctcctacttcgcctggcatctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttaattctcctggacatcgacgccaccattccaacactggctccctcgagagagacgaagtgtttgtccccaagaagaagtcagacatcaagtggtacggcaagtacctcaacaacccgttggaacgcaccgtgatgttaacggttcagttcactctcggctgtcctgagtacttag

SEQ ID NO: 14743 - DNA, 357 bp, Artificial
  Mutation in BnaA.FAD2.a introduced by TALE nuclease pair BnFAD2_T02
cctctcctccctcaccctctctcctacttcgcctggcctctctaatgggcctgccaagggagcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtcaccaagaagaagacaaacatcaagtggtacggcaagtacctcaacaaccctctggaacgcaccgggatgttaacggttcagttcactctcggctggcctttgtacttag

SEQ ID NO: 14744 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaacccttcgggacgcaccgtgatgttaacggttcagttcactctcggctggcctttgtacttag

SEQ ID NO: 14745 - DNA, 427 bp, Artificial
  Mutation in BnaA.FAD2.a introduced by TALE nuclease pair BnFAD2_T02
cctctcctccctcaccatctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacaaggcggtaatacggttatccacagaatcaggggataacgatatcgatgctgtccatgtgctgtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14746 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 14747 - DNA, 348 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggcctccacgccttcagcgactaccagtggctggacgacgccgtgggcctcgtcttccactccttcctcctcgtcccttacttagtcatcgacgccaccattcctacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14748 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagatacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14749 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggcgcgtcctaaccggcgtctgggtcatagcccacgagtgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcacacatcaagtggtacggcaagtacctcaacaaccctttgggacgcaccgtgatgttaaccgttcagttcacgctcggctggcctttgtacttag

SEQ ID NO: 14750 - DNA, 336 bp, Artificial
  Mutation in BnaA.FAD2.a introduced by TALE nuclease pair BnFAD2_T02
cctctcctccctcaccctctctcctacttcgcctggcctctctactgggcctgacaagggtgcgtcctaacgggcctctgggtcatcgcccacgaatgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaacccgttgggacgcaccgtgatgttaacggttgagttcactctcggctgtcctgtgtacttag

SEQ ID NO: 14751 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14752 - DNA, 445 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttgcgcgttcaaaagtcgcctaaggtcactatcagctagcaaatatttcttgtcaaaaatgctccactgacgtggtccagcggctgcagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 14753 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14754 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggacgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14755 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaacccgttgggacgcaccgtgatgttaacgtttcagttcactcgcggctggcctgtgtacttag

SEQ ID NO: 14756 - DNA, 358 bp, Artificial
  Mutation in BnaA.FAD2.a introduced by TALE nuclease pair BnFAD2_T02
cctctcctccctcaccctctctactacttcgcctggcctctctactgggcctgccagggctgcgtcctaaccggcgtctgggtcatagcccacgagtgcggccaccacgccttcagcgactaccagttgctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggccttagtacttag

SEQ ID NO: 14757 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatagcccactagtgcggccaccacgccttcagcgactaccagtggctggactacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14758 - DNA, 363 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaagtatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14759 - DNA, 345 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctattccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14760 - DNA, 357 bp, Artificial
  Mutation in BnaA.FAD2.a introduced by TALE nuclease pair BnFAD2_T02
cctctccgccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcctcttccactccttcctcctcgtcccttgcttctcctggaaactcatcgacgccaccattccaacactggctccctcgagatagacgaagtgtttgtccccaagaagaagtcagacatcaagtggtacggcaagtacctcagcaaccctttgggacgcacggtggtgctaaccgtccagttcacgctcggctggcctttgtgcttag

SEQ ID NO: 14761 - DNA, 363 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtgggcctcgtcttccactccttcctcctcgtcccttacttctcctggaagtatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14762 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgtccgttgtacttag

SEQ ID NO: 14763 - DNA, 351 bp, Artificial
  Mutation in BnaA.FAD2.a introduced by TALE nuclease pair BnFAD2_T02
cctctcctccctcaccctctctcctacttcgcctggcatctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccttcatcgacgccaccattccaacactggctccctcgagagggatgaagtgttcgtccccaagaagaaatccgacatcaagtggtacggaaagtacctcaacaacccgctaggacgctcggtgatgctaaccgtccagttcacgctcggctggcctttgtacttag

SEQ ID NO: 14764 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaaccgttcagttcacgctcggctggcctttgtacttag

SEQ ID NO: 14765 - DNA, 358 bp, Artificial
  Mutation in BnaA.FAD2.a introduced by TALE nuclease pair BnFAD2_T02
cctctcctccctcaccctctctcctacttcgcctggcctctctactgggcctgacaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtatcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 14766 - DNA, 332 bp, Artificial
  Mutation in BnaA.FAD2.a introduced by TALE nuclease pair BnFAD2_T02
cctctactccctcaccctctctcctacttcgcctggcctctctactgggcctgccagggctgcgtcctaaccggcgtctgggtcatagcctacgagtgcggccaccacgccttcagcgactaccagtggctggacgacaccgtcggcctcatcttccactccttcctcctcgtcccttacttctccaggaactggctccctcgagagagacgaagtgtttgtccccaagaagaagtcagacatcaagtggtacggcaagaaccgcaacagcccgtagtcacgcgccgtgatgttaacggttcagttcactctcggctggcctttgtacttag

SEQ ID NO: 14767 - DNA, 356 bp, Artificial
  Mutation in BnaA.FAD2.a introduced by TALE nuclease pair BnFAD2_T02
cctctcctccctcaccctctctcctacttctcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtccggcaagtacctcgacaacccttagggacgcaccgtgaagttacccgttcagttcactctcggctggcctttgtacttag

SEQ ID NO: 14768 - DNA, 332 bp, Artificial
  Mutation in BnaA.FAD2.a introduced by TALE nuclease pair BnFAD2_T02
cctctcctccctcaccctctcccttacctcgcctggcccctctactgggcctgcccaggctgcgtcctaaccgccttctgggtcatagcccacgagtgcggccaccacgccttcagcgactaccagtggctggacgacaccgtcggcctcatcttccactccttcctcctcgtcccttacttctcctggaactggctccctcgagagagacgaagtgtttgtccccaagaagaagtcagacatcaagtggtacggcaagtacctcaacaacccgttgggacgcaccgtgatgttaacggttcagttcactctcggctggcctgtgtacttag

SEQ ID NO: 14769 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14770 - DNA, 335 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctgggcgacaccgtcggcctcatcttccactccttcctcctcgtcccttactcaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 14771 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgccatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 14772 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 14773 - DNA, 388 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccttctgcttagtttgatgcctggcagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttggtacttag

SEQ ID NO: 14774 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 14775 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttaattctcctggacatcgacgccaccattccaacactggctccctcgagagagacgaagtgttcgtccccaagaagaagtcagacatcaagtggtacggcaagtacctcaacaaccctgtgggacgcaccgtgatgttaacggttcagttcactctcggctggccgttgtacttag

SEQ ID NO: 14776 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaaatcccacatcaagtggtacggaaagtagctcaacaacccgctaggacgcacggtgatgcaaaccgtccagttcacgctcggctggccttagtacttag

SEQ ID NO: 14777 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtcgtacggcaagtaccccaacatccctttgggacgcgccgtggtgttaacggttcaggtcgctctcggctggcctgagtacttag

SEQ ID NO: 14778 - DNA, 389 bp, Artificial
  Mutation in BnaA.FAD2.a introduced by TALE nuclease pair BnFAD2_T02
cctctcctccctcaccctgtctcctacttcgcctggcatctctactgggcctgccagggctgcgtcctaaccggcgtctgggtcatagcccacgagtgcggccaccacgccttcagcgactaccagtggctggacgaccccgtcggcctcatcttccactccttcctcctcgtcccttacttctcctcgaagtatgctggccatcgccagcaatggcggggacagtcatcgacgccaccattccaacactggctccctcgagagagacgaagtgtttgtccccaagaagaagtcagacatcaagtggtacggcaagtacctcaacaacccgctacgacgcacggtgatgctaacagccccgttcacgctcggctggccgttgtacttag

SEQ ID NO: 14779 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagtcatcgacgccaccattccaacactggctccctcgagagagacgaagtgtttgtccccaagaagaagtcagacatcaagtggtacggcaagtacctctacacccccgtcggccgcaccgggttgttaacggatcagttcactctcggttggcctttgtacttag

SEQ ID NO: 14780 - DNA, 402 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggacttccgctgccaagttcgagagacagcacatggacagcatcgatacagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 14781 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaaatccgacatcaagtggtacggcaagtacctcaacaacccgctaggacgcacggtgatgctaaccgtccagttcacgctcggctggcctttgtacttag

SEQ ID NO: 14782 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaaatcagacatcaagtggtacggcaagtacctcaacaaccctttgggacgcaccgtgatgttaaccgttcagttcactctcggctggcctttgtacttag

SEQ ID NO: 14783 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgtgtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14784 - DNA, 378 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggatatggcggcaagcaggcgatggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14785 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgtggtacttag

SEQ ID NO: 14786 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14787 - DNA, 346 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttccatcgacgccaccattccaacactggctccctcgagagagacgaagtgtttgtccccaagaagaagtcagacatcaagtggtacggcaagtacctcaacatccctttggtacgcgccgtgatgttaactgttcatttcactctcggctggcctttgtacttag

SEQ ID NO: 14788 - DNA, 345 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgaccaccagtggctggacgacgccgtgggcctcgtcttccactccttcctcctcgtcccttacttctcctattccaccattccaacactggctccctcgagagagacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 14789 - DNA, 337 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcttccacagccatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 14790 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcacgctcggctggcctttgtacttag

SEQ ID NO: 14791 - DNA, 312 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtcttggtcatagcccacgagtgcggccaccacgccttcagcgactaccagtggcttgacgacaccgtcggtctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14792 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcatgtacctcaacaaccctttgggacgcgccgtgatgttaacggttcagttcactctcggctggccgttgtacttag

SEQ ID NO: 14793 - DNA, 458 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagcggtccagcggctgttgccaccctcattgctggcgatggccaccacctgctggggggtcaagccgtgggcctggcacagcaccggcaacagccgctggagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14794 - DNA, 358 bp, Artificial
  Mutation in BnaA.FAD2.a introduced by TALE nuclease pair BnFAD2_T02
cctctcctccctcaccctctctcctacttcgcctggcctctctaatgggcctgacagggctgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggaaagtaccgcaacaacccgctaggacgcacggtgatgctaaccgtccagttcacgctcggctggcctgggtacttag

SEQ ID NO: 14795 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggactttgtacttag

SEQ ID NO: 14796 - DNA, 393 bp, Artificial
  Mutation in BnaA.FAD2.a introduced by TALE nuclease pair BnFAD2_T02
cctctcctccctcaccctctctcctacttcgcctggcctctctactgggcctgccaggactgcgtcctaaccggcgtctgggtcatagcccacgagtgcggccaccacgccttcagcgactaccagtggctggacgacaccgtcggcctcatcttccactccttcctcctcgtcccttacttctcctggaagtacaacactggctccctcgagagagacgaagtgtttgtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggccgtggtacttag

SEQ ID NO: 14797 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactacaagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14798 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccgtgtgagacgcatcgtgatgttagcggttcagttcgctctcggctggccgttgtacttag

SEQ ID NO: 14799 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 14800 - DNA, 321 bp, Artificial
  Mutation in BnaA.FAD2.a introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14801 - DNA, 319 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggcttgacgacaccgtcggtctcatcttccactccttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14802 - DNA, 353 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggacatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 14803 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 14804 - DNA, 339 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctccaccatttcaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14805 - DNA, 359 bp, Artificial
  Mutation in BnaA.FAD2.a introduced by TALE nuclease pair BnFAD2_T02
cctctcctccctcaccctctctactacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 14806 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggattcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgtcctgtgtacttag

SEQ ID NO: 14807 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggatcatcgacgccaccattccaacactgactccctcgagagagacgaagtgtttgtccctaagaagaagtcagacatcaagtggtacggcaagtacctcaacaaccctttgggacgcaccgtgatgttaacggttcagttcactctcggctggcctttgtacttag

SEQ ID NO: 14808 - DNA, 354 bp, Artificial
  Mutation in BnaA.FAD2.a introduced by TALE nuclease pair BnFAD2_T02
cctctcctccctcaccctctcccttaccccgcctggcccctctattgggcctgccaaggctgcgtcctaacgggcccctgggtcatcgcccacgagtgcggccaccacgccttcagcaactaccagtggctggacgacaccgtcggcctcatcttccactccttcctccccgtcccctacttctcctggatcatcgacgccaccattccaacactggctccctcgagagagacgaagtgtttgtccccaagaagaagtcacgcatcaagtggtacggcaaaaaccccaacaaccctttgggacgcaccgtgatgttaacagttcagttcactctcggatggccttagtacttag

SEQ ID NO: 14809 - DNA, 355 bp, Artificial
  Mutation in BnaA.FAD2.a introduced by TALE nuclease pair BnFAD2_T02
cctctactccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14810 - DNA, 355 bp, Artificial
  Mutation in BnaA.FAD2.a introduced by TALE nuclease pair BnFAD2_T02
cctctcctccctcaccctctctcctacttcgcctggcctctctactgggcctaccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14811 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggctttgtacttag

SEQ ID NO: 14812 - DNA, 357 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14813 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaaaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 14814 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaagatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14815 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaggtacctcaacaagcctttgggacgcaccgtgatgttaaccgttcagttcacgctcggctgtcctttgtacttag

SEQ ID NO: 14816 - DNA, 345 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctattccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 14817 - DNA, 345 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctattccaccattccaacactggctccctcgagagagacgaagtgtttgtccccaagaagaagtcagacatcaagtggtacggcaggtacctcaacagcccgttgggacgcaccgtgatgtcaacggttcagttcactctcggctggcctgtgtacttag

SEQ ID NO: 14818 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggtcatcgacgccaccattccaacactggctccctcgagagagacgaagtgtttgtccccaagaagaaatccgacatcaagtggtacggcaagtacctcaacaaccctttgggacgcaccgtgatgttaacggttcagttcactctcggctggcctttgtacttag

SEQ ID NO: 14819 - DNA, 356 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccatttgggacgcaccgtgatgttaacggttcagttcactctcggctggcctttgtacttag

SEQ ID NO: 14820 - DNA, 357 bp, Artificial
  Mutation in BnaA.FAD2.a introduced by TALE nuclease pair BnFAD2_T02
cctctcctccctcaccctctcccttacctcgcctggccactctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 14821 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 14822 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacatccctttgggacgcaccgtgatgttaacggttcagttcactctcggctggcctttgtacttag

SEQ ID NO: 14823 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14824 - DNA, 378 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatatggcggcaagcaggcgatggagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 14825 - DNA, 385 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcaagccgtgggcctggaacagcaccggcaacagccgctggaccgtctccagctgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14826 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctcactcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14827 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 14828 - DNA, 358 bp, Artificial
  Mutation in BnaA.FAD2.a introduced by TALE nuclease pair BnFAD2_T02
cctctcctccctcaccctctcccttacttcgcctggccgctctaatgggcctgccaaggctgcgtcctaacgggcctctgggtcatcgcccacgaatgcggccaccacgccttcagcgaccaccagtggctggacgacgccgtcggcctcgtcttccactccttcctcctcgtcccttacttctcctggaagtaccatcgacgccaccattccaacaccggatccctcgagagagacgaagtgtttgtccccaagaagaagtcagacatcaagtggtacggcaagtaccgcaacaaccctttgggacgcaccgtgatgttaaccggtcagttctctctctgctggcctttgtacttag

SEQ ID NO: 14829 - DNA, 362 bp, Artificial
  Mutation in BnaA.FAD2.a introduced by TALE nuclease pair BnFAD2_T02
cctctcctccctcaccctctctcctacttcgcctggcatctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagttacagtcatcgacgccaccattccaacactggctccctcgagagagacgaagtgtttgtccccaagaagaagtcagacatcaagtggtacggaaagtacctcaacaacccgctaggacgcacggtgatgctaaccggccagttcacgctcggctggcctttgtacttag

SEQ ID NO: 14830 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacatcccttggggacgcgccgtgatgttaacggttcagttcgctctcggctggccttagtacttag

SEQ ID NO: 14831 - DNA, 402 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcaagccgtgggcctggcacagcaccggcaacagccgctggaccgtctcctacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14832 - DNA, 339 bp, Artificial
  Mutation in BnaA.FAD2.a introduced by TALE nuclease pair BnFAD2_T02
cctctcctccctcaccctctcccttacctcgccttgcccctctactgggcctgccaaggctgcgtcctaacgggcctctgggtcatcgcccacgaatgcggccaccacgccttcagcgaccaccagtggctggccgaagccgtgggcctcgtcttccactccttcctcctcgtcccttacgacgccaccattccaacactggctccctcgggagagactaagtgtttgtccccaagaagaattcagacatcaagtggtccggcaagtacctcaccaacccgttgggtccctccgggatgttatcgtttaagttcactctcggctggccatagtacttag

SEQ ID NO: 14833 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccaggggctggacgacaccgtcggcctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttggatcgccccgtgatgttaacggttcagttcactctcggctggcctgtgtacttag

SEQ ID NO: 14834 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaaggtcatcgacgccaccattccaacactggctccctcgagagagacgaagtgtttatccccaagaagaagtcagacatcaagtggtacggcaagtacctcaacaaccctttgggacgcaccgtgatgttaacggttcagttcactctcggctggcctttgtacttag

SEQ ID NO: 14835 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagtccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 14836 - DNA, 384 bp, Artificial
  Mutation in BnaA.FAD2.a introduced by TALE nuclease pair BnFAD2_T02
ccttcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcaagccgtgggcctggcacagcaccggcaacagccgctggaccgtctccagctgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14837 - DNA, 394 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgagtgcggccaccacgccttcagcgactaccagtggctggacgacaccgtcggcctcatcttccactccttcctcctcgtcccttacttctcctggaaggattgagtgagctgataccgctcgccgcagccgaacagtcatcgacgccaccattccaacactggctccctcgagagagacgaagtgtttgtccccaagaagaagtcaaacatcaagtggtacggcaagtacctcaacaacccgttgggacgcaccgtgatgttaacggttcagttcactctcggctggcctttgtacttag

SEQ ID NO: 14838 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctgcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14839 - DNA, 353 bp, Artificial
  Mutation in BnaA.FAD2.a introduced by TALE nuclease pair BnFAD2_T02
cctctcctccctcaccctctctcctacttcgcctggcctctctactgggcctgacagggctgcgtcctaaccggcgtctgggtcatagcccacgagtgcgaccaccacgccttcagcgactaccagtggctggacgacaccgtcggcctcatcttccactccttcctcctcgtcccttacttctcctggtcatcgacgccaccattccaacactggctccctcgagagagacgaagtgtttgtccccaagaagaaatccgacatcaagtggtacggaaagtacctcaacaacccgcgaggacgcacggtgatgctaaccgaccatttcacgctcggctggcctttgtacttag

SEQ ID NO: 14840 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14841 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtatgggtcatagcccacgagtgcggccaccacgccttcagcgactaccagtggcttgacgacaccgtcggtctcatcttccactccttcctcctcgtcccttacttctcctggaaacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14842 - DNA, 356 bp, Artificial
  Mutation in BnaA.FAD2.a introduced by TALE nuclease pair BnFAD2_T02
cctctcctccctcaccctctctcctacttcgcctggccactctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 14843 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagcagtcatcgacgccaccattccaacactggctccctcgagagagacgaagtgtttgtccccaagaagaaatccgacatcaagtggtacggaaagtacctcaacaacccgcgaggacgcacggtgatgctaaccgtccagttcacgctcggctggcctgagtacttag

SEQ ID NO: 14844 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgtcaacggttcagttcactctcggctggcctttgtacttag

SEQ ID NO: 14845 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 14846 - DNA, 321 bp, Artificial
  Mutation in BnaA.FAD2.a introduced by TALE nuclease pair BnFAD2_T02
cctctcctccctcaccctctctcctacttcgcctggcctctgtaatgggcctgacaagggtgcgtcctaaccggcgtctgggtcatcgcccacgaatgcggccaccacgcattcagcgaccaccagtggctggacgacgccgtgggcctcgtcttccactccttcctcctcgtcccttacttctcctggaagagagagacgaagtgtttgtccccaagaagaagtcagacatcaagtggtacggcaagtacctcaacagccctttgggacgcaccgtgatgttaactgttcagtgcactctcggctctcctttgtgcttag

SEQ ID NO: 14847 - DNA, 355 bp, Artificial
  Mutation in BnaA.FAD2.a introduced by TALE nuclease pair BnFAD2_T02
cctctcctccctcaccctctctcctacttcgcatggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 14848 - DNA, 363 bp, Artificial
  Mutation in BnaA.FAD2.a introduced by TALE nuclease pair BnFAD2_T02
cctctcctccctcaccctctctcctacttcgcctggactctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacacagtcatcgacgccaccattccaacactggctccctcgagagggatgaagtgttcgtccccaagaagaaatccgacatcaagtggtacggaaagtacctcaacaacccgtgaggacgcacggtgatgctaaccgtccatttcactctcggctggcctgtgtacttag

SEQ ID NO: 14849 - DNA, 356 bp, Artificial
  Mutation in BnaA.FAD2.a introduced by TALE nuclease pair BnFAD2_T02
cctctcctccatcaccctctctcctacttcgcctggcctctctactgggcctgccagggctgcgtcctaaccggcgtctgggtcatagcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14850 - DNA, 355 bp, Artificial
  Mutation in BnaA.FAD2.a introduced by TALE nuclease pair BnFAD2_T02
ccctcctccctcaccctctcccttacctcgcctggcccctctactgggcctgccaaggctgcgtcctaacgggcctctgggtcatcgcccacgagtgcggccaccacgccttcagcgaccaccagtggctggacgacgccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14851 - DNA, 357 bp, Artificial
  Mutation in BnaA.FAD2.a introduced by TALE nuclease pair BnFAD2_T02
cctctcctccctcaccctctctcctacttcgcctggcccctctactgggcctgccagggctgcgtcctcaccggcgtctgggtcatagcccacgagtgcggccaccacgccttcagcgactaccagtggcttgacgccaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaggtacctcaacatgcctttgagacgcaccgtggggttaacccttcggttcacgctcggctgcccttagtgcttag

SEQ ID NO: 14852 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14853 - DNA, 336 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14854 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaagtcagacatcaagtggtacggcaaggacctcaacaacccttggggacgcgccgtgatgttaacggttaagttcactctcggctggcatgtgtacttag

SEQ ID NO: 14855 - DNA, 350 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttactaacagtcatcgacgccaccattccaactctggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14856 - DNA, 387 bp, Artificial
  Mutation in BnaA.FAD2.a introduced by TALE nuclease pair BnFAD2_T02
cctctcctccctcaccctctctcatacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtccctttgcctggcacagcaccggcaacagccgctggaccgtctccagctgtcatcgacgcaaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14857 - DNA, 349 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaacgggcctctgggtcatcgcccacgaatgcggccaccacgccttcagcgaccaccagtggctggacgacaccgtcggcctcatcttccactccttcctcctcgtcccttacttccgtcatcgacgcctccattccaacacttgctccctcgagagagacgaagtgtttgcccccaagaagaagtcagacatcgagtggtacggcaagtacctcagcacccgtctgggacggcccgtgatgtaaacggttcagttcactctcggctggccttagtacttag

SEQ ID NO: 14858 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccgttgggtcgcaccgtgatgttaacgtttcagttcactctccgctggcctgtgtacttag

SEQ ID NO: 14859 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccggtgggacgcaccgtgatgttaacggttcagttcactctcggctggcctttgtacttag

SEQ ID NO: 14860 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtccattacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14861 - DNA, 393 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcagtctcatcttccactccttcctcctcgtcccttacttctcctggagactgagcctttcgttttatctgttgtttgtcggtgaacgctcgccagcaaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14862 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagctactaccagtggctggacgacaccgtcggcctcatcttccactccttcctcctcttcccttgcttctcctggaagtcatcgacgccaccattccaacactggctccctcgagagagacgaagtgtttgtccccaagaagaagtcagacatcgagtggtacggcaagtacctcaacaacccgttggatcgcaccgggatgttaacggttcagttcactctcggctggcctttgtacttag

SEQ ID NO: 14863 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtatcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 14864 - DNA, 387 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctccaagccccccagcaggtggtggccatcgccagcaatagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14865 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaattcatcgacgccaccattccaacactggctccctcgagagagacgaagtgtttgtccccaagaagaagtcagccatcaagtggtacggcaagtacctcaacaaccctttgggacgccccgtgatgttaacggttcagttcactctccgctggcctttgtacttag

SEQ ID NO: 14866 - DNA, 443 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctgcgatggccaccacctgctggggggtcaagccgtgggcctggcacagcaccggcaacagccgctggaccgtctccagcgcctgcttgtgcagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 14867 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggatcagttcactctcggctggcctttgtacttag

SEQ ID NO: 14868 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagatcatcgacgccaccattccaacactggctccctcgagagagacgaagtgtttgtccccaagaagaagtcagacatcaagtggtacggcaagtacctcaacaacccgttgggacgcaccgtgatgttaacggttcagttcacgctcggctggcctttgtacttag

SEQ ID NO: 14869 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaacccttggggacgcgccgtgatgttaacggttcagttcactctcggctggcctttgtacttag

SEQ ID NO: 14870 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcggctaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14871 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcacacatcaagtgtcacggcaagtaccccaacatcccgctaggacgcacggtgatgctaaccggccagttcacgctccgctgccctttgcacttag

SEQ ID NO: 14872 - DNA, 358 bp, Artificial
  Mutation in BnaA.FAD2.a introduced by TALE nuclease pair BnFAD2_T02
cctctcctccctcaccctctctcctacttcgcctggcatctctactgggcctgccagggctgcgtcctaaccggcgtctgggtcatagcccacgagtgcggccaccacgccttcagctactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagttgtacggcaagttcctcagcaaccctttggtacgcaccgtgatgttaactttgcagttcactctcggctcccagatgtactag

SEQ ID NO: 14873 - DNA, 360 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaagccatcgacgccaccattccaacactggctccctcgagagagacgaagtgtttgtccccaagaagaagtcagacagcaagtggtacggcaagtacctcaacaaccctttgggacgcaccgtgatgttaacggttcagttcactctcggctggcctttgtacttag

SEQ ID NO: 14874 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcgtcctcatcttccactccttcctcctcctcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaaccgttcagttcactctcggctgtcctttgtacttag

SEQ ID NO: 14875 - DNA, 389 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgaccccgtcggcctcatcttccactccttcctcctcgtcccttacttctcctggaagtacagcaacgtcggttcgagatggcgctcgaagtcatcgacgccaccattccaacactggctccctcgagagggatgaagtgtttgtccccaagaagaagtcagacatcaagtggtacggcaagtacctcaacaaccctttgggacgcaccgtgatgttaacggttcagttcacgctaggctggcctttgtacttag

SEQ ID NO: 14876 - DNA, 362 bp, Artificial
  Mutation in BnaA.FAD2.a introduced by TALE nuclease pair BnFAD2_T02
cctctcctccctcaccctctctcctacttcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14877 - DNA, 352 bp, Artificial
  Mutation in BnaA.FAD2.a introduced by TALE nuclease pair BnFAD2_T02
cctctcctccctcaccctctctcctacttcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggcatcgacgccaccattccaacactggctccctcgagagagacgaagtgtttgtccccaagaagaagtcagacatcaagtggtacggcaagtcccccaacaaccctgagggacgcaacgtgctgttaaccgttcagttccctctcggctggcctttgtacttag

SEQ ID NO: 14878 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 14879 - DNA, 393 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacaacactggctccctcgagagagacgaagtgtttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14880 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaacccgttgggacgcaccgggatgttaacggttcagttcactctcggctggcctgtgtacttag

SEQ ID NO: 14881 - DNA, 419 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacattccgtggcgttatccagctaagcgcgaactgcaatttggagaatggcagcgcaatcacacatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 14882 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14883 - DNA, 355 bp, Artificial
  Mutation in BnaA.FAD2.a introduced by TALE nuclease pair BnFAD2_T02
cctctcctccctcaccctctcccttacctcgcctggccactctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14884 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcaactaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 14885 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctgcatcgacgccaccattccaacaccggatccctcgagagggatgaagtgttcgtccccaagaagaagtcagacatcaagtggtacgacaagtacctcaacaaccctttgggacgcaccgtgatgttaacggttcagttcactctcggctggccgttgtacgtag

SEQ ID NO: 14886 - DNA, 355 bp, Artificial
  Mutation in BnaA.FAD2.a introduced by TALE nuclease pair BnFAD2_T02
cctctcctccctcaccctctcccttacctcggctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14887 - DNA, 344 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14888 - DNA, 356 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaattacctcaacaacccttggggacgcaccgtgatgttaacggttcagttcactctcggctggcctttgtacttag

SEQ ID NO: 14889 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcgtcttccactccttcctcctcgtcccttacttctcctggagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14890 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtactgag

SEQ ID NO: 14891 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 14892 - DNA, 356 bp, Artificial
  Mutation in BnaA.FAD2.a introduced by TALE nuclease pair BnFAD2_T02
cctctcctccctcaccctctctcctacctctcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaattcatcgacgccaccattccaacactggctccctcgagagagacgaagtgtttgtccccaagaagaagtcagacatcaagtggtccggcaagtaccccaacgcccctgtgggacgcaccgtaaggttaacggttccgttcactctcggctggcctttgtacttag

SEQ ID NO: 14893 - DNA, 359 bp, Artificial
  Mutation in BnaA.FAD2.a introduced by TALE nuclease pair BnFAD2_T02
cctctcctccctcactctctcccttacctcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14894 - DNA, 348 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcgtcttccactccttcctcctcgtcccttacttagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14895 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggcctcatcttccactccttcctcctcgtcccttacttctcctggaagcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14896 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 14897 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccattccttcctcctcgtcccttacttctcctggaagcatcgacgccaccattccaacactggctccctcgagagagacgaagtgtttgtccccaagcagaagccacacatcaagtggcacggcaagtacctaaacaaccctttgggacgccccgtgatgttaacggttcagttcactctaggctggcctttgtacttag

SEQ ID NO: 14898 - DNA, 354 bp, Artificial
  Mutation in BnaA.FAD2.a introduced by TALE nuclease pair BnFAD2_T02
cctctcctccctcaccctctcccttacctcgcctggccactctactgggcctgccaaggctgcgtcctaacaggcctctgggtcatcgcccacgaatgcggccaccacgccttcagcgaccaccagtggctggacgacgccgtgggcctcgtcttccactccttcctcctcgtcccttacttctcctggaacatcgacgccaccattccaacactggctccctcgagagagacgaagtgtttgtccccaagaagaagtcagacatcaagtggtacggcaagtacctcaacaacccttggggacgcaccgtgatgttaactgttcagttcactctcggctggcctttgtacttag

SEQ ID NO: 14899 - DNA, 348 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttagtcatcgacgccaccattccaacactggctccctcgagagagacgaagtgtttgtccccaagaagaagtcagacatcaagtggtacggcaagtacctcaacaacccttggggacgcaccgtgatgtgaacggttcagttcactctcggctggccttggtacttag

SEQ ID NO: 14900 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 14901 - DNA, 329 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactaccagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 14902 - DNA, 339 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14903 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctgagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 14904 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctgaacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14905 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14906 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 14907 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagccatcgacgccaccattccaacaccggatccctcgagagggatgaagtgttcgtccccaagaagaagtcagacatcaagtggtacggcaattacctcaacaaccctttgggacgcaccgtgatgttaacggttcagttcactctcggctggcctttgtacttag

SEQ ID NO: 14908 - DNA, 405 bp, Artificial
  Mutation in BnaA.FAD2.a introduced by TALE nuclease pair BnFAD2_T02
cctctcctccctcaccctctctcctacttcgcctggcctctctactgggcctgccacggctgcgtcctaaccggcgtctgggtcatagcccacgagtgctgccaccacgccttcagcgactaccagtggctggacgacaccgtcggcctcatcttccactccttcctcctcgtcccttacttctcctggaatgttgccaccgccattgctggcgatggccaccacctgctggggggtcaagccatcgacgccaccattccaacactggctccctcgagagagacgaagtgtttgtccccaagaagaagtcacacatcaagtggtacggcaagtacctcaacacccctgagggacgcaccgtgatgttaacccttcagttcactctcggctggcctttgtacttag

SEQ ID NO: 14909 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagtgactaccagtggctggacgacaccgtcggcctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14910 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggtcatcgacgccaccattccaacactggctccctcgagagagacgaagtgtttgtccccaagaagaagtcagacatcaagtggtacggcaagtaccgcaacaaccctttgggacgcaccgtgatgttaaccggtcagtgcactctcggctggccgttgtacttag

SEQ ID NO: 14911 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttggggcgcaccgtgatgttaacggttcagttcactctcggctggcctgtgtacttag

SEQ ID NO: 14912 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 14913 - DNA, 383 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagactgagcctttcgttttatttgatgcgtcatcgacgccaccattccaacactggctccctcgagagagacgaagtgtttgtccccaagaagaagtcagacatcaagtggtacggcaattacctcaacaaccctttgggacgcaccgtgatgttaacggttcagttcactctcggctggcctttgtacttag

SEQ ID NO: 14914 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 14915 - DNA, 387 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcggccctttgcctgccacagcaccggcaacagccgctggaccgtctccagctgtcatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggctgccctttgtacttag

SEQ ID NO: 14916 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaaatccgacatcaagtggtacggaaagtacctcaacaacccgctaggacgcacggggatgctaaccgtccagttcacgctcggctggccgttgtacttag

SEQ ID NO: 14917 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaaaactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 14918 - DNA, 357 bp, Artificial
  Mutation in BnaA.FAD2.a introduced by TALE nuclease pair BnFAD2_T02
cctctcctccctcaccctctctcctacttcgcctggccactctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14919 - DNA, 347 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccacgacgccaccattccaacactggctccctcgagagagacgaagtgtttgtccccaagaagaagtcagacatcaagtggtacggcaagtacctcaacaaccctgtgggacgcaccgtgatattaacggttcagttcactctcggctggcctgggtacttag

SEQ ID NO: 14920 - DNA, 335 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcgccctcatcttccactccttcctcctcgtcccttactcaccattccaacactggctccctcgagagagacgaagtgtttgtccccaagaagaagtcagacatcaagtggtacggcaaggacctcaacaaccctttgggacgcaccgtgatgttaacggttcagttcactctcggctggcctttgtacttag

SEQ ID NO: 14921 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctgtgtacttag

SEQ ID NO: 14922 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcaccgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14923 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttccgtcatcgacgccaccattccaacactggctccctcgagagagacgaagtgtttgtccccaagaagaagtcagacagcaagtggtacggcaagtacctcaacaaccctttgggacgcacggtgatgctagccgtccagttcgcgctcggctggcctttgtacttag

SEQ ID NO: 14924 - DNA, 346 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacagtcatcgacgccaccattccaacactggctccctcgagagagacgaagtgtttgtccccaagaagaagtcagacatcaagtggtacggcaagtacctcaacaacccggtgggacgcaccgggatgtcaacggttcagtgcaccctcggctggcctttgtacttag

SEQ ID NO: 14925 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgtggccaccacgccttcagcgactaccagtggctggacgacaccgtcggcctcatcttccactccttcctcctcgtcccttacttctcctggaagtcatcgacgccaccattccaacaccggatccctcgagagggatgaagtgttcgtccccaagaagaaatccgacatcaagtggtacggcaaggaccccaacatccctttgggacgcaccgtgatgtcaacggttcagtttactctcggctggcctttgtacttag

SEQ ID NO: 14926 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14927 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgttcgtccccaagaagaaatccgacatcaagtggtacggcaagtacctcaacaaccctttgggacgcaccgtgatgttaacggttcagttcactctcggctggccttagtacttag

SEQ ID NO: 14928 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgactaccagtggctggacgacaccgtcggcctcatcttccactccttcctcctcgtcccttacttctccagtcatcgacgccaccattccaacactggctccctcgagagagacgaagtgtttgaccccaagaagaagtcagacatcaagtggtacggcaagtacctcaacaaccctttgggacgcaccgtgatgttaacggttcagttcactctcggctggcctttgtacttag

SEQ ID NO: 14929 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 14930 - DNA, 356 bp, Artificial
  Mutation in BnaA.FAD2.a introduced by TALE nuclease pair BnFAD2_T02
cctctcctccctcaccctctctcctacttcgcctggcaactctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccggtgggacgcaccgggatgttaacggttcagttcactcgcggctggcctttgtacttag

SEQ ID NO: 14931 - DNA, 356 bp, Artificial
  Mutation in BnaA.FAD2.a introduced by TALE nuclease pair BnFAD2_T02
cctctcctccctcaccctctcccttacctcgcctggcctccctactgggcctgccaagggtgcgtcctaaccggcgtctgggtcctagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtggttgtccccaagaagaagtcagacatcaagtggtacggcaagtacctcaacaaccctttgggacgcaccgtgatgttaacggttcagttcactctcggctggcctttgtacttag

SEQ ID NO: 14932 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaccatgacgccaccattccaacaccggatccctcgatagggacgaagtgttcgtccccaagaagaaatccgacatcaagtggtacggcaagtacctcaacaacccgctaggacgcacggtgatgctaaccgtccagttcaagctcggctggcctttgtacttag

SEQ ID NO: 14933 - DNA, 348 bp, Artificial
  Mutation in BnaA.FAD2.a introduced by TALE nuclease pair BnFAD2_T02
cctctcctccctcaccctctctcctacttcgcctggcatctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccatcgacgccaccattccaacactggctccctcgagagagacgaagtgtttgtccccaagaagaagtcagacatcaagtggtacggcaagtacctcaacagtccggtgggtcgcaccgtgatgttaaccggtcagtgcacgctcggctggcctgtgtacttag

SEQ ID NO: 14934 - DNA, 374 bp, Artificial
  Mutation in BnaA.FAD2.a introduced by TALE nuclease pair BnFAD2_T02
cctctcctccctcaccctctcacctccctcaccctcaaacatacctcgcctggcccctctcctgggcctgccaaggctgcgtcctaacccgcgtctgggtcatagcccacgagtgcggccaccacgccttcagcgactaccagtggctggacgacaccgtcggcctcatcttccactccttcctcctcgtcccttacttctcctggaaagtcatcgacgccaccagtccaacactggctccctcgagagagacgaagtgtctgtccccaagaagaagtctgacatcaagtggtacggcaagtaccacaacagccctttgggacgcaccgagatgttaaccgatcagttcgctctcggttgcccttggtacttag

SEQ ID NO: 14935 - DNA, 361 bp, Artificial
  Mutation in BnaA.FAD2.a introduced by TALE nuclease pair BnFAD2_T02
cctccctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttacagtcatcgacgccaccattccaacactggctccctcgagagagacgaagtgtttgtccccaagaagaagtcagacatcaagtggtacggcaagcacctcaacaaccctttgggacgcaccgtgatgttaacggttcagttcactctcggctggcctttgtacttag

SEQ ID NO: 14936 - DNA, 411 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggtggcaagcaggcgctggagacggtccagcggctgttgccggtgctgtgccaggcccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14937 - DNA, 389 bp, Artificial
  Mutation in BnaA.FAD2.a introduced by TALE nuclease pair BnFAD2_T02
cctctcctccctcaccctctcccttacctcgcctggcccctcttctgggcctgccaaggctgcgtcctaaccggcgtctgggtcatagcccacgagtgcggccaccacgccttcagcgactaccagtggcttgacgacaccgtcggcctcatcttccactccttcctcctcgtcccttacttctcctggaagtatggtggccatcgccagcaatggcggtgacagtcatcgacgccaccattccaacactggctccctcgagagagacgaagtgtttgtccccaagaagaagtcagacatcaagtggtacggcaagtacctcagcatcccttggggacgcaccgtgatgttaactgttcagttcactctcggctggcctttgtacttag

SEQ ID NO: 14938 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgactgcggccaccacgccttcagcgaccaccagtggctggacgacgccgtgggcctcgtcttccactccttcctcctcgtcccttacttctcctggaagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14939 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaccatgacgccaccattccaacaccggatccctcgatagggacgaagtgttcgtccccaagaagaaatccgacatcaagtggtacggcaagtacctcaacaacccgttgggacgcaccgtgatgttaacggttcagttcactcgcggctgccctttgtacttag

SEQ ID NO: 14940 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactgccagtggctggacgacaccgtcggcctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14941 - DNA, 329 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccacttacagtcatcgacgccaccattccaacactggctccctcgagagagacgaagtgtttgtccccaagaagaagtcagacatcaagtggtacggcaagtacctcaacaaccctttgggacgcaccgtgatgttaacgggtcagttcactctcggctgtccgttgtacttag

SEQ ID NO: 14942 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcccctcgtcccttacttctcctggatacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 14943 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14944 - DNA, 354 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14945 - DNA, 355 bp, Artificial
  Mutation in BnaA.FAD2.a introduced by TALE nuclease pair BnFAD2_T02
cctctcctccctcaccctctcacttacctcgcctggcgcctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacactggctccctcgagagagacgaagtgtttgtccccaagaagaagtcagacatcaagtggtacggcaagtacctcaacaaccctttgggacgcaccgtgatgttatcgtttcagttcactcgcggctggcctgtgtacttag

SEQ ID NO: 14946 - DNA, 451 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtgcatgcatggcgcaatgcactgacgggtgccccgctcaacttgaccccaagattgcaaaacgtggcggcgtgaccgcagtggaggcagtgcatgtcatcgacgccaccatcccaacactggctccctcgagagagacgaagtgtttgtccccaagaagaagtcaggcatcaagtggtacggcaagtgcctcagcaaccctttgggaggcaccgtgatgttaacgtttcagttcactctcgcccgccctgtgtacttag

SEQ ID NO: 14947 - DNA, 355 bp, Artificial
  Mutation in BnaA.FAD2.a introduced by TALE nuclease pair BnFAD2_T02
cctctcctccctcaccctctcacttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggaaagtacctcaacaacccgttaggacgcacggtgatgctaaccgttcagttcacgctcggctggcctttgtacttag

SEQ ID NO: 14948 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14949 - DNA, 357 bp, Artificial
  Mutation in BnaA.FAD2.a introduced by TALE nuclease pair BnFAD2_T02
cctctcctccctcaccctctcccttacctcgcctggcccctctaatgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgttatgttaacggttcagttcactcgtgtctggcctttgtacttag

SEQ ID NO: 14950 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcatgtacctcaacaacccgctaggacgcacggtgatgctaaccgtccagttcacgctcggctggcctttgtacttag

SEQ ID NO: 14951 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaaagtcatcgacgccaccataccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14952 - DNA, 336 bp, Artificial
  Mutation in BnaA.FAD2.a introduced by TALE nuclease pair BnFAD2_T02
cctctcctccctcaccctctctcctacttcgcctgcgctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttggcacgcaccgtgatgttaacggttcagttccctcacggctggcctttgtacttag

SEQ ID NO: 14953 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccgggaagaagtcagacatcaagtggtacggcaagtacctcaacaaccctttgggacgcaccgtgatgttaacggttcagttcactctcggctggcctttgtacttag

SEQ ID NO: 14954 - DNA, 291 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccattccaacactggctccctcgagagagacgaagtgtttgtccccaagaagaagtcagacatcaagtggtacggcaagtacctcaacaaccctttgggacgcaccgtgatgttaacggttcatttcactctcggctggcctttgtacttag

SEQ ID NO: 14955 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagttcctcaacaaccctctgggacgcaccgtgattttaacggttcagttcactctcggctggcctctgtacttag

SEQ ID NO: 14956 - DNA, 318 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14957 - DNA, 350 bp, Artificial
  Mutation in BnaA.FAD2.a introduced by TALE nuclease pair BnFAD2_T02
cctctcctccctcaccctctatcctacttcgcctggcctctctaatgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctcatcgacgccaccattccaacactggctccctcgagagagacgaagtgtttgtccccaagaagaagtcagacatcaagtggtacggcaagtacctcaacaaccctttgggacgcaccgtgatgttaacgtttcagttcactctcggctggcctgtgtacttag

SEQ ID NO: 14958 - DNA, 354 bp, Artificial
  Mutation in BnaA.FAD2.a introduced by TALE nuclease pair BnFAD2_T02
cctctcctccctcaccctctctcagacttcgcctggccccgccactgagccttccaagggcgggtccaaaaaggagcctgggtcacagcccacgagtgcggacaccacgccttcagcgactaccagtggccggacgacaccgtcggcctcatcttccactccttcctcctcgtcccttacttctcctggatcatcgacgccaccattccaacacgggctccctcgagagagacgaagtgtttgtccccaagaagaagtcagacatcaagtggtacggcaagtacctcaacaaccctctgggacgccccgtgatgttaacggttcagttcactctcggctggcctttgtacttac

SEQ ID NO: 14959 - DNA, 362 bp, Artificial
  Mutation in BnaA.FAD2.a introduced by TALE nuclease pair BnFAD2_T02
cctctcctccctcaccctctaccttacctcgcctggcccctctactgcgcctgacaaggctgcgtcctaacgggcctctgggtcatcgcccacgaatgcggccaccacgccttcagcgaccaccagtggctggacgacaccgtcggcctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcaggcctttgtacttag

SEQ ID NO: 14960 - DNA, 356 bp, Artificial
  Mutation in BnaA.FAD2.a introduced by TALE nuclease pair BnFAD2_T02
cctctcctccctcaccctctcccttacctcgcctggcctctctaatgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 14961 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 14962 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgctaacggttcagttcactctcggctggcctttgtacttag

SEQ ID NO: 14963 - DNA, 332 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgaccaccagtggctggacgacgccgtgggcctcgtcttccactccttcctcctcgtcccttacttctcctggaactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14964 - DNA, 355 bp, Artificial
  Mutation in BnaA.FAD2.a introduced by TALE nuclease pair BnFAD2_T02
cctctcctccctcaccctctctcctacttcgcctggcctctatactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14965 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacacccctttgggacgcaccgtgatgttaacggttcagttcactctcggctggcctttgtacttag

SEQ ID NO: 14966 - DNA, 345 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgatgccgtgggcctcgtcttccactccttcctcctcgtcccttacttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14967 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgcgcggctggcctttgtacttag

SEQ ID NO: 14968 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggattacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 14969 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 14970 - DNA, 356 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcaaacatcaagtggtacggcaagtacctcaacatccctttgggacgcaccgtgatgttaacggttcagttcactctcggctgccctttgtacttag

SEQ ID NO: 14971 - DNA, 405 bp, Artificial
  Mutation in BnaA.FAD2.a introduced by TALE nuclease pair BnFAD2_T02
cctctcctccctcgccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatgttgccaccgccattgctggcgatggccaccacctgctggggggtcaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14972 - DNA, 341 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacaccgtcggcctcatcttccactccttcctcctcgtccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14973 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagggatgaagtgttcgtccccaagaagaaatccgacatcaagtggtacggaaagtaccgcaacaacccgctgggacgcacagtgatgctacccgtccagttcacgctcggctggcctttgtacttag

SEQ ID NO: 14974 - DNA, 318 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggcctcatcttccactccttcctcctcgtcccttacttctcctggagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 14975 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgttcgtccccaagaagaagtcagacatcaagtggtacggcaagtacctcaacaaccctttgggacgcaccgtgatgttaacggttaagttcactctcggctggcctttgtacttag

SEQ ID NO: 14976 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaacccttttggacgcaccgtgatgttaacggttcagttcacgctcggctggcctttgtacttag

SEQ ID NO: 14977 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttatcgacgccaccattccaacactggctccctcgagagagacgaagtgtttgtccccaagaagaaggcagacatcaagtggtacggcaggtaccactacaacccgtcgggacgcaccgtgatgttaacggttcagttcactctcggctggcctttgtacttag

SEQ ID NO: 14978 - DNA, 391 bp, Artificial
  Mutation in BnaA.FAD2.a introduced by TALE nuclease pair BnFAD2_T02
cctctcctccctcaccctctctcctacttcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtgtaggtcgttcgctccaagctgggctgtgtgcacgaatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 14979 - DNA, 306 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcatcgacgccaccattccaacactggctccctcgagagagacgaagtgtttgtccccaagaagaagtcagacatcaagtggtacggcaagtacctcaacaaccctttgcgacgcaccgtgatgttaacggttcagttcacgctcggctgccctttgtgcttag

SEQ ID NO: 14980 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttggtacttag

SEQ ID NO: 14981 - DNA, 406 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgaccaccagtggctggacgacaccgtcggcctcatcttccactccttcctcctcgtcccttacttctcctggaagtctcatattcactctcaatccaaataatctgcaccggatctcgcccatagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 14982 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtaccccaacaaccctttgggacgcaccgtgaggttaacggatcagttcacgctcggctggcctttgtacttag

SEQ ID NO: 14983 - DNA, 357 bp, Artificial
  Mutation in BnaA.FAD2.a introduced by TALE nuclease pair BnFAD2_T02
cctctcctccctcaccctgtctcctacttcgcctggcctctctactgggcctgccagggctgcgtcctaaccggcgtctgggtcatagcccacgagtgcggccaccacgccttcagcgactaccagtggctggacgacaccgtcggcctcatcttccactacttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14984 - DNA, 372 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttactcaagtcagaggtggcgaaacccgacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcattctcggctggcctttgtacttag

SEQ ID NO: 14985 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagatcatcgacgccaccattccaacactggctccctcgagagagacgaagtgtttgtccccaagaagaagtcagacatcaagtggtacggcaagtacctcaacaaccctttgggacgcaccgtgctgttaacggttcagttcactctcggctggcctttgtacttag

SEQ ID NO: 14986 - DNA, 312 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 14987 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagtcatcgacgccaccattccaacactggctccctcgagagagacgaagtgtttgtccccaagaagaagtcagacatcaagtggtccggcaagtacctcaacacccctgtgggacgcaccgtgatgttaacccttcagttcactctcggctggcctttgtacttag

SEQ ID NO: 14988 - DNA, 394 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccgctcgccatgcatgcactgcctccactgcggtagtcatcgacgccaccattccaacactggctccctcgagagagacgaagtgtttgtccccaagaagaaatccgacatcaagtggtacggaaagtacctcaacaaccctctaggacgcacggtgatgctaaccctccagttcacgctcggctggcctttgtacttag

SEQ ID NO: 14989 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 14990 - DNA, 341 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaaattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14991 - DNA, 344 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttactcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 14992 - DNA, 409 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggaaccttgaccgaacgcagcggtggtaacggcgcagtggcggttttcatggcttgagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14993 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatgtcatcgacgccaccattccaacactggctccctcgagagagacgaagtgtttgtccccaagaagaagtcagacatcaagtggtacggcaagtacctcaacaaccctttgggacgcaccgtgatgttatcggttcaggtcactcgtggctggcctttgtacttag

SEQ ID NO: 14994 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaagtcatcgacgccaccattccaacactggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 14995 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 14996 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaacatcgacgccaccattccaacactggctccctcgagagagacgaagtgtttgtccccaagaagaagtcagacatcaagtggtacggcaagtgcctcaacaaccctttgggacgcaccgtgattttaacggttcagttcactctcggctggcctttgtacttcg

SEQ ID NO: 14997 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14998 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtcttggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 14999 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 15000 - DNA, 359 bp, Artificial
  Mutation in BnaA.FAD2.a introduced by TALE nuclease pair BnFAD2_T02
cctctcctccctcaccctctcccttacctcgcctggccactctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacgtcaagtggtacggcgagtaccgcaacagcccgttggggcgcgccgggatgttagcggttcagtgcgctctcggctggcctgggtacttag

SEQ ID NO: 15001 - DNA, 332 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 15002 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacgtttcagttcactctcggctggcctttgtacttag

SEQ ID NO: 15003 - DNA, 347 bp, Artificial
  Mutation in BnaA.FAD2.a introduced by TALE nuclease pair BnFAD2_T02
cctctcctccctcaccctctcccttacctcgcctggcccctctactcggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctccacgacgccaccattccaacactggctccctcgagagagacgaagtgtttgtccccaagaagaagtcagacatcaagtggtacggcaagtacctcaacatccctttggtacgcaccgtgatgttaacggttcagttcactctcggctggcctttgtacttag

SEQ ID NO: 15004 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcccggaaagtcatcgacgccaccattccaacactggctccctcgagagagacgaagtgtttgtccccaagaagaaacccgacatcaagtgttacggagagtacctcaacaagcggccaggccggccggtgattcttaccgcccaggtcacgctcgcctgcccttagtacttag

SEQ ID NO: 15005 - DNA, 358 bp, Artificial
  Mutation in BnaA.FAD2.a introduced by TALE nuclease pair BnFAD2_T02
cctctcctccctcaccctctcccatacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgagatgttaaccgtccagttcacgctcggctggcctttgtacttag

SEQ ID NO: 15006 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccctacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15007 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15008 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcgtcctcatcttccactccttcctcctcgtcccttacttctcctggaatcatcgacgccaccattccaacactggctccctcgagagagacgaagtgtttgtccccaagaagaagtcagacatcaagtggtacgacaagtacctcaacatccctttgggacgcaccgtgatgttaacggttcaggtcattcgcgcccggcctgagtacttag

SEQ ID NO: 15009 - DNA, 353 bp, Artificial
  Mutation in BnaA.FAD2.a introduced by TALE nuclease pair BnFAD2_T02
cctctcctccctcaccctctcccttacctcgcctggcacctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 15010 - DNA, 355 bp, Artificial
  Mutation in BnaA.FAD2.a introduced by TALE nuclease pair BnFAD2_T02
cctctcctccctcaccctctctcctacttcgcttggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgcgcggctggcctttgtacttag

SEQ ID NO: 15011 - DNA, 346 bp, Artificial
  Mutation in BnaA.FAD2.a introduced by TALE nuclease pair BnFAD2_T02
cctctcctccctcaccctctcccttacctcgcctggcccctctaatgggcctgccaaggctgcgtcctaacgggcctctgggtcatcgcccacgaatgcggccaccacgccttcagcgaccaccagtggctggacgacaccgtcggcctcatcttccactccttcctcctcgtcccttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcgtcgggcctttgtacttag

SEQ ID NO: 15012 - DNA, 351 bp, Artificial
  Mutation in BnaA.FAD2.a introduced by TALE nuclease pair BnFAD2_T02
cctctcctccctcaccctctctcctacttcgcctggcctgtctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggatcgacgccaccattccaacactggctccctcgagagagacgaagtgtttgtccccaagaagaagtcagacatcaagtggtacggcaagtcccccaacaccccgctaggacgcaaggggaggctaaccgtccctttcccgctcggctggcctttgtacttag

SEQ ID NO: 15013 - DNA, 291 bp, Artificial
  Mutation in BnaA.FAD2.a introduced by TALE nuclease pair BnFAD2_T02
cctctcctccctcaccctctctcctacttcgcctggcctctctactgggcctgccagggcggcgtcctaaccggcgtctgggtcatagcccacgagtgcggccaccacgccttcagcgactaccagtggcttgacgacaccgtcggaagactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15014 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15015 - DNA, 318 bp, Artificial
  Mutation in BnaA.FAD2.a introduced by TALE nuclease pair BnFAD2_T02
cctctcctccctcaccctctcccttacctcgcctggcccctctaatgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggagagagacgaagtgtttgtccccaagaagaagtcagacatcaagtggtacggcaagtacctcaacaacccttttggacgcaccgtgatgctaacggtccagttcactctcggctggcctttgtacttag

SEQ ID NO: 15016 - DNA, 345 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctattccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15017 - DNA, 358 bp, Artificial
  Mutation in BnaA.FAD2.a introduced by TALE nuclease pair BnFAD2_T02
cctctcctccctcaccctctctactacttcgcctggcctctctaatgggcctgacagggctgcgtcctaaccggcgtctgggtcatagcccacgagtgcggccaccacgccttcagcgactaccagtggcttgacgacaccgtcggtctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcagcaaccctttggggcgcaccgtgatgttaaccggtcagttgactctcggctgtcctttgtgcttag

SEQ ID NO: 15018 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttctctctcggctggcctttgtacttag

SEQ ID NO: 15019 - DNA, 359 bp, Artificial
  Mutation in BnaA.FAD2.a introduced by TALE nuclease pair BnFAD2_T02
cctctcctccctcaccctctctcctacttcgcctggcctctctaatggggctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtaccgcaacaaccctttgggacgcaccgtgatgttaacggttcagttcactcgtgtgcggcctgtgtacttag

SEQ ID NO: 15020 - DNA, 358 bp, Artificial
  Mutation in BnaA.FAD2.a introduced by TALE nuclease pair BnFAD2_T02
cctctcctccctcaccctctatcctacttcgcctggcctctgtactgggccggccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagggtcatcgacgccaccattccaacactggctccctcgagagagacgaagtgtttgtccccaagaagaagtcagacatcaagtggtacggcaagtaccgtaacaacccttggggacgcaccgtgatgttatcgggtcaggtctctcgcggctggcctttgtgcttag

SEQ ID NO: 15021 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15022 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaacagccatcgacgccaccattccaacactggctcactcgagagagacgaagtgtttgtccccaagaagaagtcagacatcaagtggtacggcaagtacctcaacaaccatttgggacgcaccgtgatgttaacggttcagttcactctcggctggcctttgtacttag

SEQ ID NO: 15023 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcaactaccagtggctggacgacaccgtaggcctcatcttccactccttcctcctcgtcccttacttctcctgatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15024 - DNA, 357 bp, Artificial
  Mutation in BnaA.FAD2.a introduced by TALE nuclease pair BnFAD2_T02
cctctcctccctcaccctctcccttacctcgcctggcacctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgttatgttaacggttcagttcactctcggccggcctttgtacttag

SEQ ID NO: 15025 - DNA, 356 bp, Artificial
  Mutation in BnaA.FAD2.a introduced by TALE nuclease pair BnFAD2_T02
cctctcctccctcaccctctctcctacttcgcctggcctctctactgggccagccagggctgcgtcctaaccggcgtctgggtcatagcccacgagtgcggccaccacgccttcagcgactaccagtggctggacgacaccgtcggcctcatcttccactccttcctcctcgtcccttacttctcctggatgtcatcgacgccaccattccaacactggctccctcgagagagacgaagtgtttgtccccaagaagaagtccgacatcaagtggtacgccaagtacctcaacaatcctttgggaagcaccgtgatgctaacgtgccagttcactctcggctggcctttgtacttag

SEQ ID NO: 15026 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 15027 - DNA, 274 bp, Artificial
  Mutation in BnaA.FAD2.a introduced by TALE nuclease pair BnFAD2_T02
cctctcctccctcaccctctcacttacctcgcctggcccctctcctgggcctgccaaggctgcgtcctaacgggcctctgggtcatcgcccacgaatgcggccaccgcgccttcagcgaccaccattccaacactggctccctcgagagagactaagtgtttgtccccaagaagaagtcagacatcaagtggtacggcaagtacctcaacaaccctttgggacgcaccgggatgttaacggttcaggtcactcgcggctggcctttgtacttag

SEQ ID NO: 15028 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 15029 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccatgtgggacgcaccgtgattgtaacggttcagttcactcccggcgggccttggtacttag

SEQ ID NO: 15030 - DNA, 355 bp, Artificial
  Mutation in BnaA.FAD2.a introduced by TALE nuclease pair BnFAD2_T02
cctctcctccctcaccctctcccttacctcgcctggcacctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacaacccttttggacgcaccgggattttaacggttcagttcactctcggctggcctttgtacttag

SEQ ID NO: 15031 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaacgggcctctgggtcatcgcccacgaatgcggccaccacgccttcagcgactaccagtggctggacgacaccgtcggcctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 15032 - DNA, 348 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15033 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcatcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15034 - DNA, 415 bp, Artificial
  Mutation in BnaA.FAD2.a introduced by TALE nuclease pair BnFAD2_T02
cctctcctccctcaccctctctcctacttcgtctggcctctctactgggcttgccagggccgcgccctaaccggcgtctgggtcatagcccacgagtgcggccaccacgccttcagcgactaccagtggctggacgacaccgtcggcctcatcttccactccttcctcctcgtcccttacttctcctggaagtatagcgcgtcagtgagcggggaagcggaagagcgcccaatacgcaaaccgcctctcagtcatcgacgccaccattccaacactggctccctcgagagagacgaagtgtttgtccccaagaagaagtcacacatcaagtggtacgtcaagtcccccaacgcgccttatggacgcaccatgatgcttaccctccagttcacgctcggctggcctttgtacttag

SEQ ID NO: 15035 - DNA, 352 bp, Artificial
  Mutation in BnaA.FAD2.a introduced by TALE nuclease pair BnFAD2_T02
cctctcctccctcaccctctcacttacctcggctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacactggctccctcgagagagacgaagtgtttgtccccaagaagaagtcacacatcaagtggtacggcaagtacctcaacaaccctttgggacgcaccgtgatgttaacggttcagttcactctcggctggcctttgtacttag

SEQ ID NO: 15036 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaaatccgacatcaagtggtacggaaaggacctcaacaacccgctgggacgcagggtgatgctaaccggccagttcacgcttggcgggcctgtgtacttag

SEQ ID NO: 15037 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtaccgcaacaaccctttgggacgcaccgtgatgttaacggttcagttcactctcggctggcctttgtacttag

SEQ ID NO: 15038 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtcttag

SEQ ID NO: 15039 - DNA, 318 bp, Artificial
  Mutation in BnaA.FAD2.a introduced by TALE nuclease pair BnFAD2_T02
cctctcctccctcaccctctctcctacttcgcctggactctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagagagacgaagtgtttgtccccaagaagaagtcagacatcaagtggtacggcaagtacctcaacagccctttgggacgcaccgtgaggttaacggttcagttcactcctggctggcctttgtacttag

SEQ ID NO: 15040 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacagccctttgggacgcaccgtgatgttaacggttcagttcgctctcggctggcctttgtacttag

SEQ ID NO: 15041 - DNA, 359 bp, Artificial
  Mutation in BnaA.FAD2.a introduced by TALE nuclease pair BnFAD2_T02
cctctcctccctcaccctctaacttacctcgcctggaccctctaatgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaacccgctaggacgcacggtgatgctaaccggccagttcacgcgcggctggcctttgtacttag

SEQ ID NO: 15042 - DNA, 329 bp, Artificial
  Mutation in BnaA.FAD2.a introduced by TALE nuclease pair BnFAD2_T02
cctctcctccctcaccctctctcctacttcgcctggactctctactgggcctgccagggctgcgtcctaaccggcgtctgggtcatagcccacgagtgcggccaccacgccttcagcgactaccagtggctggacgacaccgtcggcctcatcttccactaccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15043 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagttccccagcatgcgttttggacgcaccgtgagtcttccggctcatttccctcgcggccgccctttgtacttag

SEQ ID NO: 15044 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15045 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttgtacttag

SEQ ID NO: 15046 - DNA, 351 bp, Artificial
  Mutation in BnaA.FAD2.a introduced by TALE nuclease pair BnFAD2_T02
cctctcctccctcaccctctctcctacttcgcctggcctccctactgggcctgccagggctgcgtcctaaccggcgtctgggtcatagcccacgagtgcggccaccacgccttcagcgactaccagtggctggacgacatcgtcggcctcatcttccactccttcctcctcgtcccttacttctcctggaacgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 15047 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaagttcatcgacgccaccattccaacactggctccctcgagagagacgaagtgtttgtccccaagtagaagtcagacatcaagtggtacggcaagtacctcaacaaccctttgggacgcaccgtgatgttaacggttcagttcactctcggctggcctttgtacttag

SEQ ID NO: 15048 - DNA, 441 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccactccttcagcgactaccagtggctggacgacaccgtcggcctcatcttccactccttcctcctcgtcccttacttctcctggaagctcggtttgatcgacaggggcgcagcaccgcgaggcagtggtcggccacgggtttacacgcgcgcgcatcgttgcgttaagccggtcatcgacgccaccattccaacactggctccctcgagagagacgaagtgtttgtccccaagaagaagtcagacatcaagtggtacggcaaggaccgcaacaaccctttggggcgcatcgtgatgttaacgggtcaggtcactgtcggctggactttgtacttag

SEQ ID NO: 15049 - DNA, 366 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacaatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15050 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 15051 - DNA, 349 bp, Artificial
  Mutation in BnaA.FAD2.a introduced by TALE nuclease pair BnFAD2_T02
cctcccctccctcaccctctcccttacctcgcctggcccctctatcgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctatcgacgccaccattccaacactggctccctcgagagagacgaagtgtttgtccccaagaagaagtcagacatcaagtggtacggcaagtacctcaacaaccctttgggacgcaccgtgattttaacgcttcaggtcactctcggctgccctttgtacttag

SEQ ID NO: 15052 - DNA, 358 bp, Artificial
  Mutation in BnaA.FAD2.a introduced by TALE nuclease pair BnFAD2_T02
cctctcctccctcaccctctatcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcaggcctttgtacttag

SEQ ID NO: 15053 - DNA, 356 bp, Artificial
  Mutation in BnaA.FAD2.a introduced by TALE nuclease pair BnFAD2_T02
cctctcctccctcaccctctatcctacttcgcctggcctctctactgcgcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15054 - DNA, 331 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctccatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 15055 - DNA, 335 bp, Artificial
  Mutation in BnaA.FAD2.a introduced by TALE nuclease pair BnFAD2_T02
cctctcctccctcaccctctaccttacctcgcctggcctctctaatgggcctgccaagggagcgtcctaaccggcgtctgggtcatagcccacgagtgcggccaccacgccttcagcgactaccagtggctgtacgacaccgtcggcctcatcttccactccttcctcctcgtcccttactcaccattccaacactggctccctcgagagagacgaagtgtttgtccccaagaagaagtcagacatcaagtggtacggcaaggacctcaacaaccctttgggacgcaccgttatgttaacgttgaatgtcactcgtggctggcctgtgtacttag

SEQ ID NO: 15056 - DNA, 357 bp, Artificial
  Mutation in BnaA.FAD2.a introduced by TALE nuclease pair BnFAD2_T02
cctctcctccctcaccctctctcctacttcgcctggcctctctcctgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcacggtgatgctatccgtccagttctcgcgcggctggccttggtacttag

SEQ ID NO: 15057 - DNA, 387 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctccaagccccccagcaggtggtggccatcgccagcaatagtcatcgacgccaccattccaacactggctccctcgagagagacgaagtgtttgtccccaagaagaagtcagacatcaagtggtacggcaagtacctcaacaaccctttgggacgcaccgtgatgttatcggttcagttcactctcgcctggcctttgtacttag

SEQ ID NO: 15058 - DNA, 409 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagcaacagccgctggaccgtctccagcgcctgcttgccgccatcgtggctggcgagtcatcgacgccaccattccaacactggctccctcgagagagacgaagtgtttgtccccaagaagaagtcagacatcaagtggtacggcaagtacctcaacaaccctgagggacgcaccgtgatgttaacggttcagttcactctcggctggcctttgtacttag

SEQ ID NO: 15059 - DNA, 354 bp, Artificial
  Mutation in BnaA.FAD2.a introduced by TALE nuclease pair BnFAD2_T02
cctctcctccctcaccctctcccttacctcgcctggcccccctcctgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacatcgacgccaccattccaacactggctccctcgagagagacgaagtgtttgtccccaagaagaagtcagacatcaagtggtacggcaaggacctcaacaaccctttgggtcgcaccgggatgttaacggtgcagttcactcgcggctggcctttgtacttag

SEQ ID NO: 15060 - DNA, 347 bp, Artificial
  Mutation in BnaA.FAD2.a introduced by TALE nuclease pair BnFAD2_T02
cctctcctccctcaccctctctcctacttcgcctggcctctctactgggcctgccagggccgcgtcctaaccggcgtctgggtcatagcccacgagtgcggccaccacgccttcagcgactaccagtggctggacgacaccgtcggcctcatcttccactccttcctcctcgtcccttacttatccatgacgccaccattccaacaccggatccctcgatagggacgaagtgttcgtccccaagaagaaatccgacatcaagtggtacggcaagtacctcaacaacccgctaggacgcacggtgaggctatgcggccagttgaggcttggcggccctttgtacttag

SEQ ID NO: 15061 - DNA, 355 bp, Artificial
  Mutation in BnaA.FAD2.a introduced by TALE nuclease pair BnFAD2_T02
cctctcctccccaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaaatccgacatcaagtggtacggaaagtacctcaacaacccgctaggacgcacggtgatgctaaccggccagttcacgctcggctggcctttgtacttag

SEQ ID NO: 15062 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaacagtcatcgacgccaccattccaacactggctccctcgagagagacgaagtgtttgtccccaagaagaagtcagacatcaagtggtacggcaagtacctcaacaaccctttgggacgcaccgtgatgttaccggttcagttcactctcggctggcctttttacttag

SEQ ID NO: 15063 - DNA, 356 bp, Artificial
  Mutation in BnaA.FAD2.a introduced by TALE nuclease pair BnFAD2_T02
cctctcctccctcaccctctctcctacttcgcctggcctctctcccgagcctgccagggctgcgtcccaaccggcgtctgggtcatagcccacgagtgcggccaccacgccttcagcaactaccagtggctggaccacaccgtctgcctcgacttccactccttcctcctcgtcccttacttctcctggaagtcatcgacgcctccatgccaacagtggctccctcgagagagacgaagtgtttgcccccaagaagaagtcacgcatcgagtggtacggcaagtacctcagcgaccgttcgggacgcgccctgggtttaacggcacgggtcagtctcggccgcctttagtacttag

SEQ ID NO: 15064 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggcgggcctttgtacttag

SEQ ID NO: 15065 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttctcctggaagtacacagccatcgacgccaccattccaacactggctccctcgagagagacgaagtgtttgtccccaagaagaagtcagacatcaagtggtacggcaagtacctcaacaaccctttgggacgcaccgtgatgttaacggttcagtttactctcggctggcctttgtacttag

SEQ ID NO: 15066 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcaacgccaccattccaacactggctccctcgagagagacgaagtgtttgtccccaagaagaagtcagacatcaagtggtacggcaagtacctcaacaaccctttgggacgcaccgtgatgttaacgttcagttcactctcggctggcctttgtacttag

SEQ ID NO: 15067 - DNA, 427 bp, Artificial
  Mutation in BnaA.FAD2.a introduced by TALE nuclease pair BnFAD2_T02
cctctcctccctcaccctctctcctacttcgcctggcatctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtggcgatggccaccacctgctccggggtcaagccgtgggcctggcacagcaccggcaacggccgctgggcagtcatcgacgccaccagtccaacactggctccctcgagagagacgaagtgtttgtccccaagaagaagtcagacatcaagtggtacggcaagtacctcaacaaccctttgggacgcaccgtgaggttaacggttcagttctctgtcggctggcctttgtattag

SEQ ID NO: 15068 - DNA, 391 bp, Artificial
  Mutation in BnaA.FAD2.a introduced by TALE nuclease pair BnFAD2_T02
cctctcctccctcaccctctctcctacttcgcctggcacctctactgggcctgccaaggctgcgtcccaacgggcctctgggtcatcgcccacgaatgcggccaccacgccttcagcgaccaccagtggctggacgacgccgtgggcctcgtcttccactccttcctcctcgtcccttacttctcctggaagtgggcctggcacagcaccggcaacagccgctggagtcatcgacgccaccattccaacactggctccctcgagagagacgaagtgtttgtccccaagaagaagtcagacatcaagtggtacggcaagtacctcaacaaccctttgggacgcaccgggatgttaacgtttcagttcactctcggctggcctttgtacttag

SEQ ID NO: 15069 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccgacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15070 - DNA, 413 bp, Artificial
  Mutation in BnaA.FAD2.a introduced by TALE nuclease pair BnFAD2_T02
cctctcctccctcaccctctctcctacttcgcctggcctctctacagggcctgccaagggcgcgtcctaaccggcgtctgggtcatagcccacgagtgcggccaccacgccttcagcgactaccagtggctggacgacaccgtcggcctcatcttccactccttcctcctcgtcccttacttctcctggaagtggcacagcaccggcaacagcgcctgcaccgtctccagcgcctgcttgccaccaatatcatcgacgccaccattccaacactggctccctcgagagagacgaagtgtttgtccccaagaagaagtcagacatcaagtggtacggcaagtacctcaacaaccgtgtgggacgcaccgtgatgttagcgtttcaggtcactctcgtgggtccttgttacttag

SEQ ID NO: 15071 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatggtaacggttcagttcactctcggctggcctttgtacttag

SEQ ID NO: 15072 - DNA, 363 bp, Artificial
  Mutation in BnaA.FAD2.a introduced by TALE nuclease pair BnFAD2_T02
cctctcctccctcaccctctctcctacttcgcctggtctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacacagtcatcgacgccaccattccaacactggctccctcgagagagacgaagtgtttgtccccaagaagaaatccgacatcaagtggtacggaaagtacctcaacaacccgctaggacgcacggggatgctaaccgtccagttcacgctcggcgggcctttgtacttag

SEQ ID NO: 15073 - DNA, 357 bp, Artificial
  Mutation in BnaA.FAD2.a introduced by TALE nuclease pair BnFAD2_T02
cctctcctccctcaccctctctcctacttcgcctggcctctctaatgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaaggcagacatcaagtggtacggcaagtacctcaacaaccctttgggacgcaccgtgatgttaacggttcaggtcactcgcggctggcctttgtacttag

SEQ ID NO: 15074 - DNA, 387 bp, Artificial
  Mutation in BnaA.FAD2.a introduced by TALE nuclease pair BnFAD2_T02
cctctcctccctcaccctctgtcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggccccccagcaggtggtggccatcgccagcaatagtcatcgacgccaccattccaacactggctccctcgagagagacgaagtgtttgtccccaagaagaagtcagacatcaagtggtacggcgaggacctcaacaaccctttgggtcgcaccgtgatgttaacggttcagttctctcgcgcctggcctgtgtacttag

SEQ ID NO: 15075 - DNA, 358 bp, Artificial
  Mutation in BnaA.FAD2.a introduced by TALE nuclease pair BnFAD2_T02
cctctcctccctcaccctctcacttacctcgcctggcccctctcctgggcctgccaaggctgcgtcctaacgggcctctgggtcatcgcccacgaatgcggccaccacgccttcagcgaccaccagtggctgcacgacgccgtgggcctcgtcttccactccttcctcctcgtcccttacttctcctggaagtgtcatcgacgccaccattccaacactggctccctcgagagagacgaagtgtttgtccccaagaagaagtcacacatcaagtggtacggcaagtacctcaacaaccctttgggacgcaccgtgatgctaacggttcagttcactctcggccggcctttgtacttag

SEQ ID NO: 15076 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 15077 - DNA, 273 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15078 - DNA, 454 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctgacggtccagcgcctgcttgccggtgctgtgccaggcccacggcttgaccccccagcaggtggtggccaccgccagcaatggcggtggcaagcaggcgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactag

SEQ ID NO: 15079 - DNA, 350 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactcctttctcctcgtcccttactcctcctcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 15080 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacactggctccctcgagagagacgaagtgtttgtccccaagaagaagtcagacatcaagtggtacggcaagtacctcaacaaccctttgggacgcaccgtgattttaacggttcagttcactctcggccggcctttgtacttag

SEQ ID NO: 15081 - DNA, 454 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtacgatgttccagattacgctatcgatatcgccgatctacgcacgctcggctacagccagcagcaacaggagaagatcaaaccgaaggttcgttcgagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15082 - DNA, 356 bp, Artificial
  Mutation in BnaA.FAD2.a introduced by TALE nuclease pair BnFAD2_T02
cctctcctccctcaccctcaaccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactcgcggctggcctgtgtacttag

SEQ ID NO: 15083 - DNA, 355 bp, Artificial
  Mutation in BnaA.FAD2.a introduced by TALE nuclease pair BnFAD2_T02
cctctcctccctcaccctctcacttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15084 - DNA, 349 bp, Artificial
  Mutation in BnaA.FAD2.a introduced by TALE nuclease pair BnFAD2_T02
cctctcctccctcaccctctatcctacttcgcctggcctctctactgcgcctgacaagggtgcgtcctaaccggcgtctgggtcatagcccacgagtgcggccaccacgccttcagcgactaccagtggctggacgacaccgtcggcctcatcttccactccttcctcctcgtcccttacttccgtcatcgacgccaccattccaacactggctccctcgagagagacgaagtgtttgtccccaagaagaaggcaaacatcaagtggtacggcaaggacctcaacaaccctttaggacgcaccgtgatgataacgggtcaggtcactgtcgtgaggcatttgtgcttag

SEQ ID NO: 15085 - DNA, 332 bp, Artificial
  Mutation in BnaA.FAD2.a introduced by TALE nuclease pair BnFAD2_T02
cctctcctccctcaccctctcacctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15086 - DNA, 356 bp, Artificial
  Mutation in BnaA.FAD2.a introduced by TALE nuclease pair BnFAD2_T02
cctctcctccctcaccctctctcctacttcgcctggcatctctactgagcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 15087 - DNA, 361 bp, Artificial
  Mutation in BnaA.FAD2.a introduced by TALE nuclease pair BnFAD2_T02
cctctcctccctaccctctctcctacttcgcctggcctctctactgggcctgccaagggtgcgtcctaaccggcgtctgggtcatagcccacgagtgcggccaccacgccttcagcgactaccagtggctggacgacgccgtcggcctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15088 - DNA, 342 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttctcctggaagtaccggataccggatccctcgagagggatgaagtgttcgtccccaagaagaagtcagacatcaagtggcacgtcaagtaccccaacaaccctgtgggacgcaccgtgatgttaacgcttccgttcactctcggctggcctttgtacttag

SEQ ID NO: 15089 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcgcgcccggcaggcctttgtacttag

SEQ ID NO: 15090 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcccatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 15091 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaatgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15092 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgttcgtccccaagaagaaatccgacatcaagtggtacggaaagtacctcaacaacccgctaggacgcacggtgatgctatccgtccagttcacgttcggctggcctttgtacttag

SEQ ID NO: 15093 - DNA, 345 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgacgaccagtggctggacgacaccgtcggtctcatcttccactccttcctcctcgtcccttacagtcatcgacgccaccattccaacactggctccctcgagagagacaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15094 - DNA, 353 bp, Artificial
  Mutation in BnaA.FAD2.a introduced by TALE nuclease pair BnFAD2_T02
cctctcctccctcaccctctcacctacttcgcctggcctctctactgggcctgccaagggtgcgtcctaacgggcctctgggtcatcgcccacgagtgcggccaccacgccttcagcgactaccagtggctggacgacaccgtcggcctcatcttccactccttcctcctcgtcccttacttctcctagtcatcgacgccaccattccaacactggctccctcgagagagacgaagtgtttgtccccaagaagaagtcagacatcaagtggtacggcgagtacctcaacaaccctttgggacgcaccgtgaggttaacggtgcaattcactcgcggctgccctgtgtacttag

SEQ ID NO: 15095 - DNA, 330 bp, Artificial
  Mutation in BnaA.FAD2.a introduced by TALE nuclease pair BnFAD2_T02
cctctcctccctcaccctctctcctacttcgcctggactctctactgggcctgccaaggctgcgtcctaacgggcctctgggtcatcgcccacgaatgcggccaccacgccttcagcgaccaccagtggctggacgacgccgtcggtctcatcttccactccttcctcctcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 15096 - DNA, 357 bp, Artificial
  Mutation in BnaA.FAD2.a introduced by TALE nuclease pair BnFAD2_T02
cctctcctccctcaccctctctcctacttcgcctggcccatctactgggcctgacaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacactggctccctcgagagagacgaagtgtttgtccccaagaagaagtcagacatcaagtggtacggcaagtacctcaacaacccgttggtacgcaccgtgatgttatcggttcagttcactctcgtctggcctttttacttag

SEQ ID NO: 15097 - DNA, 343 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtccctgtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttagc

SEQ ID NO: 15098 - DNA, 355 bp, Artificial
  Mutation in BnaA.FAD2.a introduced by TALE nuclease pair BnFAD2_T02
cctctcctccctcaccctctcccttacctcgcctggcccctctactgggcctgacaaggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttggtacgcaccgtgatgttaacgtttcagttcactctcgtctggcctttgtacttag

SEQ ID NO: 15099 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggcaggcctttgtacttag

SEQ ID NO: 15100 - DNA, 356 bp, Artificial
  Mutation in BnaA.FAD2.a introduced by TALE nuclease pair BnFAD2_T02
cctctcctccctcaccctctcccctacttcgcctggcctctctaatgggcctgacaagggtgcgtcctaaccggcgtctgggtcatcgcccacgaatgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttatcggttcagttcactcgcgtcggtcctttgtacttag

SEQ ID NO: 15101 - DNA, 357 bp, Artificial
  Mutation in BnaA.FAD2.a introduced by TALE nuclease pair BnFAD2_T02
cctctcctccctcaccctctcacttacctcgcctggcccctctactgagcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcgctctcggctggcctttgtacttag

SEQ ID NO: 15102 - DNA, 355 bp, Artificial
  Mutation in BnaA.FAD2.a introduced by TALE nuclease pair BnFAD2_T02
cctctcctccctcaccctctcccttacctcgcctggcccctctcatgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaagtctcgacgccaccattccaacactggctccctcgagagacacgaagtgtttgtccccaagaagaagtcagacatcaagtggtacggcaagtacctcaacaaccctgtgggacgcaccgggatgttaacggtgcaggtctctctcggctggcctttgtacttag

SEQ ID NO: 15103 - DNA, 357 bp, Artificial
  Mutation in BnaA.FAD2.a introduced by TALE nuclease pair BnFAD2_T02
cctctcctccctcaccctctctcctacttcgcctggactctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15104 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctttgggtcatcgcccacgaatgcggccaccacgccttcagcgaccaccagtggctggacgacgccgtgggcctcgtcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 15105 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcctctgggtcatcgcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgatcggctggcatttgtacttag

SEQ ID NO: 15106 - DNA, 358 bp, Artificial
  Mutation in BnaA.FAD2.a introduced by TALE nuclease pair BnFAD2_T02
cctctcctccctcaccctctcccttacctcgcctggcccctctcctgggcctgccaaggatgcgtcctaacgggcctctgggtcatcgcccacgaatgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacgggtcagttcactctcggctggcctttgtacttag

SEQ ID NO: 15107 - DNA, 358 bp, Artificial
  Mutation in BnaA.FAD2.a introduced by TALE nuclease pair BnFAD2_T02
cctctcctccatcaccctctctcctacttcgcctggcctctctcctgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgattgtaacggttcaggtcactctcggcgggccttggtacttag

SEQ ID NO: 15108 - DNA, 383 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagactgagcctttcgttttatttgatgcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcgtctggcctttgtacttag

SEQ ID NO: 15109 - DNA, 336 bp, Artificial
  Mutation in BnaA.FAD2.a introduced by TALE nuclease pair BnFAD2_T02
cctctcctccctcaccctctatcctacttcgcctggcctctctactgggcctgacagggctgcgtcctaaccggcgtctgggtcaaagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaaatccgacatcaagtggtacggaaagtacctcaacaacccgctagggcgcacggtgatgctatccgtccatgtcacgctcggctggcctttgtacttag

SEQ ID NO: 15110 - DNA, 353 bp, Artificial
  Mutation in BnaA.FAD2.a introduced by TALE nuclease pair BnFAD2_T02
cctctcctccctcaccctctctcctacttcgcctggtctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatcgacgccaccattccaacactggctccctcgagagggatgaagtgttcgtccccaagaagaaatccgacatcaagtggtacggaaaggacctcaacaacccgctgggacgcacggtgatgctaaccgtccagttcacgcgcggctggcatgtgtacttag

SEQ ID NO: 15111 - DNA, 357 bp, Artificial
  Mutation in BnaA.FAD2.a introduced by TALE nuclease pair BnFAD2_T02
cctctcctccctcaccctctctcctacttcgcctggcctctctaccgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15112 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtcggcctcatcttccactccttcctcctcgtcccttacttctcctggaagtagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 15113 - DNA, 358 bp, Artificial
  Mutation in BnaA.FAD2.a introduced by TALE nuclease pair BnFAD2_T02
cctctcctccctcaccctctcccttacctcgcctggcccctctcctgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgaggttaacggtgcagttcactcccggccgccctttgtacttag

SEQ ID NO: 15114 - DNA, 356 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgtgggacgcaccgtgaggttaacggttcagttcactctcggcgggccttggtccttag

SEQ ID NO: 15115 - DNA, 358 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacgtttcagttctctctcggcgggcctttgtacttag

SEQ ID NO: 15116 - DNA, 357 bp, Artificial
  Mutation in BnaA.FAD2.a introduced by TALE nuclease pair BnFAD2_T02
cctctcctccctcaccctctcacttacctcgcctggcacccctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggtcatcgacgccaccattccaacactggctccctcgagagagacgaagtgtttgtccccaagaagaagtcaaacatcaagtggtacggcaagtacctcaacaaccctttgggacgcaccgtgatgttaacggttcagttcactctcggctggcctttgtacttag

SEQ ID NO: 15117 - DNA, 354 bp, Artificial
  Mutation in BnaA.FAD2.a introduced by TALE nuclease pair BnFAD2_T02
cctctcctccctcaccctctctcctacttcgcctggcgtctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcacacatcaagtggtacggcaagtacctcaacaacccttagagacgcaccataatcttaccggtccacttcactctcggctggcctttgtacttag

SEQ ID NO: 15118 - DNA, 392 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacgtgcattgcgcttaccagaggaaaactagaaactcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15119 - DNA, 422 bp, Artificial
  Mutation in BnaA.FAD2.a introduced by TALE nuclease pair BnFAD2_T02
cctctcctccctcaccctctatcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacggcttgaccccggagcagttggtggccatcgccagccacgatggcggcaagcaggcgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggcgggcctttgtacttag

SEQ ID NO: 15120 - DNA, 359 bp, Artificial
  Mutation in BnaA.FAD2.a introduced by TALE nuclease pair BnFAD2_T02
cctctcctccctcaccctctctcctacttcgcctggcctctctcctgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtaccccaacaaccctgtgtgacgcaccgtgattctaacgcctcagttccctctcggctggcctttgtacttag

SEQ ID NO: 15121 - DNA, 340 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15122 - DNA, 393 bp, Artificial
  Mutation in BnaA.FAD2.a introduced by TALE nuclease pair BnFAD2_T02
cctctcctccctcaccctctctcctacttcgccttgcatctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacaacactggctccctcgagagagacgaagtgtttgtcatcgacgccaccattccaacaccggatccctcgagagagacgaagggtttgtccccaagatgaagtcagacatcaagtggtacggcaagtacctcaacaaccctttgggacgcaccgggaggttaacggtgcagttcactcgcggctggcctttgtacttag

SEQ ID NO: 15123 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaaagccatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 15124 - DNA, 356 bp, Artificial
  Mutation in BnaA.FAD2.a introduced by TALE nuclease pair BnFAD2_T02
cctctcctccctcaccctctatcctacttcgcctggcctctttactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagccatcgacgccaccattccaacaccggatccctcgagagggatgaagtgttcgtccccaagaagaaatccgacatcaagtggtacggcaagtacctcaacaaccctttgggacgcaccgtgatgttaacggtgcagttcactgtcggctggcctttgtacttag

SEQ ID NO: 15125 - DNA, 356 bp, Artificial
  Mutation in BnaA.FAD2.a introduced by TALE nuclease pair BnFAD2_T02
cctctcctccctcaccctctctcctacttcgcctggcatctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 15126 - DNA, 362 bp, Artificial
  Mutation in BnaA.FAD2.a introduced by TALE nuclease pair BnFAD2_T02
ctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaagtacacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15127 - DNA, 357 bp, Artificial
  Mutation in BnaA.FAD2.a introduced by TALE nuclease pair BnFAD2_T02
cctctcctccctcaccctctctcctacttcgcctggcctctctactgggcctgtcagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 15128 - DNA, 357 bp, Artificial
  Mutation in BnaA.FAD2.a introduced by TALE nuclease pair BnFAD2_T02
cctctcctccctcaccctctctcctacttcgcctggcctctctaatgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgcgcggctggcctttgtacttag

SEQ ID NO: 15129 - DNA, 418 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtaggggaagccgaagtttccaaaaggtcgttgatcaaagctcgccgcgttgtttcatcaagcccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 15130 - DNA, 362 bp, Artificial
  Mutation in BnaA.FAD2.a introduced by TALE nuclease pair BnFAD2_T02
cctctcctccctcaccctctatcctacttcgcctggcctctctactgggcctgacagggctgcgtcctaaccggcgtctgggtcctagcccacgagtgcggccaccacgccttcagcgactaccagtggctggacgacaccgtcggcctcatcttccactccttcctcctcgtcccttacttctcctggaagttacagtcatcgacgccaccattccaacactggctccctcgagagggatgaagtgttcgtccccaagaagaaatccgacatcaagtggtacggaaagtacctcagcaacccgctaggacgcacggtgatgctaaccctccagttcacgcgcggctggcctttgtacttag

SEQ ID NO: 15131 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctaggctggcctttgtacttag

SEQ ID NO: 15132 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgagggtaacggttcagttcactctcgtctggccttggtacttag

SEQ ID NO: 15133 - DNA, 359 bp, Artificial
  Mutation in BnaA.FAD2.a introduced by TALE nuclease pair BnFAD2_T02
cctctcctccctcaccctctctcctacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtccctcaacagccgtgtcggacgcgcctagatgttaacggctcaggtcactctcggcggcccttggtacttag

SEQ ID NO: 15134 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaaggacctcaacaaccctttgggacgcaccgtgatgttaacgtttcagttcacttgcggctggcctttgtacttag

SEQ ID NO: 15135 - DNA, 336 bp, Artificial
  Mutation in BnaA.FAD2.a introduced by TALE nuclease pair BnFAD2_T02
cctctcctccctcaccctctctcctacttcgcctggcctctctactgagcctgccaagggcgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgttcgtccccaagaagaagtcagacatcaagtggtacggcaagtacctcaacaaccctttgggacgcaccgtgatgttaacggttcagttcactcccggctggcctttgtacttag

SEQ ID NO: 15136 - DNA, 357 bp, Artificial
  Mutation in BnaA.FAD2.a introduced by TALE nuclease pair BnFAD2_T02
cctctcctccctcaccctctcccctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15137 - DNA, 354 bp, Artificial
  Mutation in BnaA.FAD2.a introduced by TALE nuclease pair BnFAD2_T02
cctctcctccctcaccctctcccctacttcgcctggcccctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgggagagacgaagtgtttgtccccaagaaaaagtcacacatcgagtggttcggcaagtacctcaacaaccctgtgggacgcaccgtgatgttaacggttcagttcactctcggctggcctttgtacttag

SEQ ID NO: 15138 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagccagacatcaagtggtacggcaagtacctcaacaaccctttgggacgcaccgtgatgttaacggttcagttccctctcggctggcctttgtacttag

SEQ ID NO: 15139 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacactggccccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 15140 - DNA, 427 bp, Artificial
  Mutation in BnaA.FAD2.a introduced by TALE nuclease pair BnFAD2_T02
cctctcctccctcaccctctaccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacaaggcggtaatacggttatccacagaatcaggggataacgatatcgatgctgtccatgtgctgtacagtcatcgacgccaccatcccaacactggctccctcgagagagacgaagtgtttgtccccaagaagaagtcaaacatcaagtggtacggcaagtacctcaacaaccctttgggacgcaccgtgatgttaacggttcagttcactctcgtctggcctttgtacttag

SEQ ID NO: 15141 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatatcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15142 - DNA, 326 bp, Artificial
  Mutation in BnaA.FAD2.a introduced by TALE nuclease pair BnFAD2_T02
cctctcctccctcaccctctctcctacttcgcctggcatccctactgggcctgccagggctgcgtcctaaccggcgtctgggtcatagcccacgagtgcggccaccaaaccttcagcgactaccagtgccttgacgacaccgtcggtctcatcttccactccttcctcctcgtcccttacttctcctggatccctcgagagggatgaagtgttcctccccaagaagaaatccgacatcaagtggtacggaaaggacctcaacaacccgctaggacgcgcggtgatactaaccttccaggtcacgctcgactggcctttttacttag

SEQ ID NO: 15143 - DNA, 355 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagtgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 15144 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagatcaccgacgccaccattccaacactggctccctcgagagagacgaagtgtttgtccccaagaagaagtcagccatcaagtggtacggaaaggtcctcaacaacccgctaggacgcacggtgatgctaaccgtccagttctcgctcgtctggcctttgtacttag

SEQ ID NO: 15145 - DNA, 356 bp, Artificial
  Mutation in BnaA.FAD2.a introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggctggacgacgccgggggcctcgtcttccactccttcctcctcgtcccttacttctcctggaagttatcgacgccaccattccaacactggctccctcgagagagacgaagtgtttgtccccaagaagaagtcagacatcaagtggtacggcgagcacctcaacaagcctttgggacgcaccgtgattttaacggttcaattgactcgcgcccggccttagtacttag

SEQ ID NO: 15146 - DNA, 345 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtacattccaacactggctccctcgagagagacgaagtgtttgtccccaagaagaagtcagacatcaagtggtacggcaagtacctcaacaaccctttgggacgcaccgtgatgttaaccgtcccgttcacgctcggctggcctttgtacttag

SEQ ID NO: 15147 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaagtcatcgacgccaccattccaacactggctccctcgagagagacgaagtgtttgtccccaagaagaagtcggacatcaagtggtacggcaagtacctcaacaaccctttgggacgcaccgtgatgttaacggttcagttcactctcggctggcctttgtacttag

SEQ ID NO: 15148 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagttcctcaacaaccctttgggacgcaccgtgatgttaacggtgcagttcactctcggctgccctttgtacttag

SEQ ID NO: 15149 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttctcgcgcggctggcctttgtacttag

SEQ ID NO: 15150 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 15151 - DNA, 360 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 15152 - DNA, 357 bp, Artificial
  Mutation in BnaA.FAD2.a introduced by TALE nuclease pair BnFAD2_T02
cctctcctccctcaccctctctcctacttcgcctggcctctctactgcgcctgccaagggtgcgtcctaaccggcgtctgggtcatagcccacgagtgcggccaccacgccttcagcgactaccagtggctgtacgacaccgtcggcctcatcttccactccttcctcctcgtcccttacttctcctggaaagtcatcgacgccaccattccaacactggctccctcgagagagacgaagtgtttgtccccaagaagaagtccgacatcaagtggtacggaaagtacctcaacaacccgctaggacgcacggtgatgctaaccgtccagttcacgcgcggctggcctttatacttag

SEQ ID NO: 15153 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcggctaccagtggctggacgacaccgtcggcctcatcttccactccttcctcctcgtcccttacttctcctggaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcatttgtacttag

SEQ ID NO: 15154 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtaagacatcaagtggtacggcaagtacctcaacaaccctttgggacgcaccgtgatgttaacggttcagttcactctcggctggccttgtacttag

SEQ ID NO: 15155 - DNA, 357 bp, Artificial
  Mutation in BnaA.FAD2.a introduced by TALE nuclease pair BnFAD2_T02
cctctcctccctcaccctctaccttacctcgcctggcccctctactgggcctgacaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaattacctcaacaaccctttgggacgcaccgtgatgttaacggttcagttcactctcggctggcctttgtacttag

SEQ ID NO: 15156 - DNA, 358 bp, Artificial
  Mutation in BnaA.FAD2.a introduced by TALE nuclease pair BnFAD2_T02
cctctcctccctcaccctctctcctacttcgcctggcctctctcctgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaacagccatcgacgccaccattccaacactggctccctcgagagagacgaagtgtttgtccccaagaagaagtcagacatcaagtggtacggcaagtacctcaacaacccttggggacgcaccgtgatgttaacggtgcatgtcactcgcgcgcggcctgagtacttag

SEQ ID NO: 15157 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactgactccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15158 - DNA, 357 bp, Artificial
  Mutation in BnaA.FAD2.a introduced by TALE nuclease pair BnFAD2_T02
cctctcctccctcaccctctcgcttacctcgcctggcctctctcctgggcctgccagggctgcgtcctaaccggcgtatgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccttggggacgcaccgtgaggttaacgcttcagttcactctcgcctggcctttgtacttag

SEQ ID NO: 15159 - DNA, 356 bp, Artificial
  Mutation in BnaA.FAD2.a introduced by TALE nuclease pair BnFAD2_T02
cctctcctccctcaccctctcccttacctcgcctggcccctctactgcgcctgacaaggctgcgtcctaacgcgcctctgggtcatcgcccacgaatgcggccaccacgccttcagcgaccaccagtggctggacgacgccgtgggcctcgtcttccactccttcctcctcgtcccttacttctcctggtagccatcgacgccaccattccaacactggctccctcgagagagacgaagtgtttgtccccaagaagaaggcagacatcaagtggtacggcaaggacctcaacaacccttttggacgcaccgggatgttaacggttcagttcactgacgtcgggcctttgtacttag

SEQ ID NO: 15160 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggcgcgtcctaaccggcgtctgggtcatagcccacgagtgcggccaccacgccttcagcgaccaccagtggctggacgacgccgtgggcctcgtcttccactccttcctcctcgtcccttacttctcctggaaaccatcgacgccaccattccaacaccggatccctcgagagagacgaagtgtttgtccccaagaagaaatccgacatcaagtggtacggaaagtacctcaacaaccctttgggacgcaccgtgagtataacggttcagttcactctcggctggcctttgtacttag

SEQ ID NO: 15161 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgaggttaacggttcaggtcactctcggctggcctttgtacttag

SEQ ID NO: 15162 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagttggttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15163 - DNA, 336 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 15164 - DNA, 469 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgactaccagtggctggacgacgccgtgggcctcgtcttccactccttcctcctcgtcccttacttctcctggaagtgcgccgttaccaccgctgcgttcggtcaaggttctggaccagttgcgtgagcgcatacgctacttgcatacttgacagcgacggtccctaacgctgccgggtgttggcttagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 15165 - DNA, 356 bp, Artificial
  Mutation in BnaA.FAD2.a introduced by TALE nuclease pair BnFAD2_T02
cctctcctccctcaccctctaccttacctcgcctggcccctctactgggcctgccaaggctgcgtcctaacgggcgtctgggtcatagcccacgagtgcggccaccacgccttcagcgactaccagtggctggacgacaccgtcggcctcatcttccactccttcctcctcgtcccttacttctcctggaagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 15166 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 15167 - DNA, 318 bp, Artificial
  Mutation in BnaA.FAD2.a introduced by TALE nuclease pair BnFAD2_T02
cctctcctccctcaccctctcccttacctcgcctggcccctctactgcgcctgccaaggctgcgtcctaacggccctctgggtcatagcccacgagtgcggccaccacgccttcagcgactaccagtggctggacgacaccgtcgtcctcatcttccactccttcctcctcgtcccttacttctcctggagagagacgaagtgtttgtccccaagaagaagtcagacatcaagtggtacggcaagtacctcaacaaccctgggggacgcaccgtgatgataacggttcagttcactctcggctggcctttgtactgag

SEQ ID NO: 15168 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcggctaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15169 - DNA, 446 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtactttgcaagcagcagattacgcgcagaaaaaaaggatctccgctcccggcggatttgtcctactcaggagagcgttcaccgaaaacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 15170 - DNA, 347 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcctcttccactcctttctcctcgtcccttactcctcctcatcgacgcccccattccaacactggctccctcgagagagacggagtgtttgtccccaagaagaagccagacatcaagtggtacggcaagtacctcaacaaccctggggggcgcaccgtggtgataactgttcagttctctcgcggcgggcctttgttag

SEQ ID NO: 15171 - DNA, 331 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctccatcgacgccaccattccaacactggctccctcgagagagacgaagtgtttgtccccaagatgaagtcagacatcaagtggtacggaaagtacctcaacaacccgctaggacgcacggtgatgctaaccgtccagttcacgctcggctggcctttgtacttag

SEQ ID NO: 15172 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgtcaccgtcggcctcatcttccactccttcctcctcgtcccttacttctcctggaagtcatcgacgccaccattccaacactggctccctcgagagagacgaagtgtttgtccccaagaagaagtcacacatcaagtggtacggcaagtacctcaacatcccttcgggacgcaccgtgatgttaacggtgcagttcactcgcgtctggcctttgtacttag

SEQ ID NO: 15173 - DNA, 351 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15174 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggtagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15175 - DNA, 357 bp, Artificial
  Mutation in BnaA.FAD2.a introduced by TALE nuclease pair BnFAD2_T02
cctctcctccctcaccctctatcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctgtgggacgcaccgtgaggttatcggttcagttcactctcggcgggcctttgtacttag

SEQ ID NO: 15176 - DNA, 356 bp, Artificial
  Mutation in BnaA.FAD2.a introduced by TALE nuclease pair BnFAD2_T02
cctctcctccctcaccctctatcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15177 - DNA, 357 bp, Artificial
  Mutation in BnaA.FAD2.a introduced by TALE nuclease pair BnFAD2_T02
cctctcctccatcaccctctctcctacttcgcctggcctccctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 15178 - DNA, 356 bp, Artificial
  Mutation in BnaA.FAD2.a introduced by TALE nuclease pair BnFAD2_T02
cctctcctccctcaccctctatcctacttcgcctggcctctctactgggcctgccagggctgcgtcctaaccggcgtctgggtaatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgctccgtgatggtaacggttcagttcactctcggctggcctttgtacttag

SEQ ID NO: 15179 - DNA, 384 bp, Artificial
  Mutation in BnaA.FAD2.a introduced by TALE nuclease pair BnFAD2_T02
cctctcctccctcaccctctatcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggaagccacgatggcggcaagcaggcgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15180 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatcgacgccaccattccaacactggctccctcgagagagacgaagtgtttgtccccaagaagaagtcagacatcaagtggtacggcaagtacctcaacaaccctttgggacgcaccgtgatggtaacggttcagttcactctcggcgggcctttgtacttag

SEQ ID NO: 15181 - DNA, 359 bp, Artificial
  Mutation in BnaA.FAD2.a introduced by TALE nuclease pair BnFAD2_T02
cctctcctccctcaccctctaccttacctcgcctggcctctctactgggcctgccaagggtgcgtcctaaccggcgtctgggtcatagcccacgagtgcggccaccacgccttcagcgaccaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttatcggttcagttcactctcggctggcctttgtacttag

SEQ ID NO: 15182 - DNA, 441 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaaggggatgggatccgatgaagacaatcgacaaataatgattttattttgactgatagtgacctgttcgttgcaacaaattgataagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15183 - DNA, 348 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttagtcatcgacgccaccattccaacactggctccctcgagagagacgaagtgtttgtccccaagaagaaatccgacatcaagtggtacggaaagtacctcaacaaccctttgggacgcaccgtgatgttaacggttcagttcactctcggctggcctttgtacttag

SEQ ID NO: 15184 - DNA, 349 bp, Artificial
  Mutation in BnaA.FAD2.a introduced by TALE nuclease pair BnFAD2_T02
cctctcctccctcaccctctatcctacttcgcctggtctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcgtctggcctttgtacttag

SEQ ID NO: 15185 - DNA, 336 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatctcccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15186 - DNA, 347 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctccacgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcgggcctttgtacttag

SEQ ID NO: 15187 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcgacgccaccattccaacactggctccctcgagagagacgaagtgtttgtccccaagaagaagtcaggcatcaagtggtacggcaagtacctcagcaaccctttgggacgcaccgtgaggttaacggttcagttcactctcggctggcctttgtacttag

SEQ ID NO: 15188 - DNA, 357 bp, Artificial
  Mutation in BnaA.FAD2.a introduced by TALE nuclease pair BnFAD2_T02
cctctcctccctcaccctctatcctacttcgcctggcctctctactgggcctgccaagggcgcgtcctaaccggcgtctgggtcatagcccacgagtgcggccaccacgccttcagcgactaccagtcgctggacgacaccgtcggcctcatcttccactccttcctcctcgtcccttacttctcctggaaagtcatcgacgccaccattccaacactggctccctcgagagagacgaagtgtttgtccccaagaacaagtcacacatcaagtggtacggcaagtacctcaacaaccctctgggccgcaccgtgagtttaacggttcggttcactcccggctggcctttgtgcttag

SEQ ID NO: 15189 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcagccaccacgccttcagcgactaccagtggctggacgacaccgtcggtctcatcttccactccttcctcctcgtcccttaatcgtgtcatcgacgccaccattccaacactggctccctcgagagagacgaagtgtttgtccccaagaagaagtccgacatcaagtggtacggcaagtacctcaacaacccttggggacgcaccgtgatgttaacggttcagttcactctcggctggcctttgtacttag

SEQ ID NO: 15190 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 15191 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttatcggttcaggtctctcccgtctggcctttgtgcttag

SEQ ID NO: 15192 - DNA, 312 bp, Artificial
  Mutation in BnaA.FAD2.a introduced by TALE nuclease pair BnFAD2_T02
cctctcctccctcaccctctctcctacttcgcctggcctctctcctgggcctgccagggctgcgtcctaaccggcgtctgggtcatagcccacgagtgcggccaccacgccttcagcgactaccagtggcttgacgacaccgtcggtctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 15193 - DNA, 357 bp, Artificial
  Mutation in BnaA.FAD2.a introduced by TALE nuclease pair BnFAD2_T02
cctctcctccctcaccctctaccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatgtcatcgacgccaccattccaatactggctccctcgagagagacgaagtgtttgtccccaagaagaaatccaacatcaagtggtacggaaagtacctcaacaacccgctaggacgcacggtgatgctaaccgtccagttcacgctcggctggcctttgtacttag

SEQ ID NO: 15194 - DNA, 363 bp, Artificial
  Mutation in BnaA.FAD2.a introduced by TALE nuclease pair BnFAD2_T02
cctctcctccctcaccctctctcctacttcgcctggcctctctcctgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtatacagtcatcgacgccaccattccaacactggctccctcgagagagacgaagtgtttgtccccaagaagaagtcacacatcaagtggtacggcaagtacctcaacaaccctttgggacgcaccatgatgttaacggttcagttcactctcggcgggcctttgtacttag

SEQ ID NO: 15195 - DNA, 348 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttctcctggaacgccaccattccaacaccggatccctcgagagggatgaagttttcgtccccaagaagaaatccgacatcaagtggtacggcaagtacctcaacaaccctttgggacgcaccgtgatgttaacggttcagttcactctcggctggcctttgtacttag

SEQ ID NO: 15196 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaaatccgacatcaagtggtacggaaagtacctcaacaacccgctaggacgcagggtgatgctaaccggccagttcacgctcggctggcctttgtacttag

SEQ ID NO: 15197 - DNA, 356 bp, Artificial
  Mutation in BnaA.FAD2.a introduced by TALE nuclease pair BnFAD2_T02
cctctcctccctcaccctctctcctacttcgcctggcctctctaatgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacagcaagtggtacgccaagtacctcaacaaccctttgggacgcaccgtgaggttaacggttcagttctctctcggctggccttggtacttag

SEQ ID NO: 15198 - DNA, 332 bp, Artificial
  Mutation in BnaA.FAD2.a introduced by TALE nuclease pair BnFAD2_T02
cctctcctccctcaccctctctcctacttcgcctggcctctctactgggcctgacagggctgcgtcctaaccggcgtctgggccatagcccacgggtgcggccaccacgacttcagcgactaccaggggctggacgacaccgtgggcctcatcttccactccttcctcctcgtcccttacttctcctggaactggctccctcgagagagacgaagtgtttgtccccacgaagaagtcagacatcaagtggtacggcaagtacctcaacaaccctttgggacgcacagtgatgttaacgtttcagttcactcgcggctggcctttgtacttag

SEQ ID NO: 15199 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 15200 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctgaaaatcgacgccaccattccaacactggctccctcgagagagacgaagtgttcgtccccaagaagaagtcagacatcaagtggtacggcaagtacctcaacaaccctttgggacgcaccgtgatgctaacggttcagttcactctcggctggcctttgtacttag

SEQ ID NO: 15201 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaacccttggggacgcaccgtgatgataacggagcagttcacgcgcggcgggcctttgtacttag

SEQ ID NO: 15202 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaaatcagacatcaagtggtacggcaagtacctcaacaaccctttgggacgcaccgtgatgttaacggttcagttcactctcggctggcctttgtacttag

SEQ ID NO: 15203 - DNA, 363 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15204 - DNA, 292 bp, Artificial
  Mutation in BnaA.FAD2.a introduced by TALE nuclease pair BnFAD2_T02
cctctcctccctcaccctctcccttacctcgcctggcccctctcctgggcctgccaaggctgcgtcctaccgggcctctgggtcatcgcccacgaatgcggccaccacgccttcagcgaccaccagtgtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcattggtacttag

SEQ ID NO: 15205 - DNA, 361 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctgtacttag

SEQ ID NO: 15206 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcctcttccactccttcctcctcgtcccttacttctcctggaagtagtcatcgacgccaccattccaacactggctccctcgagagagacgaagtgtttgtccccaagaagaagtcagacatcaagtggtacggcaagtaccgcaacaaccctttgggacgcaccgtgatgttaacggttcagttcactctcggctggcctttgtacttag

SEQ ID NO: 15207 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggccgcaccgtgatgttaacggtgcaggtcactctcggctggcctttgtacttag

SEQ ID NO: 15208 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcgtcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacgtag

SEQ ID NO: 15209 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15210 - DNA, 346 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggcgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15211 - DNA, 332 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15212 - DNA, 452 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacggccaccacctgctccggggtcaagccgtgggcctggcacagttggaaacttcggcttcccctggagagagcgagattctccgcgctgtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 15213 - DNA, 356 bp, Artificial
  Mutation in BnaA.FAD2.a introduced by TALE nuclease pair BnFAD2_T02
cctctcctccctcaccctctgccttacctcgcctggaccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacgtttcagttctctctcggctggcctttgtacttag

SEQ ID NO: 15214 - DNA, 355 bp, Artificial
  Mutation in BnaA.FAD2.a introduced by TALE nuclease pair BnFAD2_T02
cctctcctccctcaccctctgccttacctcgcctggcccctctaatgggcctgccaaggctgcgtcctaacgggcctctgggtcatcgcccacgaatgcggccaccacgccttcagcgactaccagtggctggacgacaccgtcggcctcatcttccactccttccccctcgtccctgacttctccgggaatcatcgacgccaccatcccaacactggctccctcgagagagacgaagtgtttgtccccaagaagaagtcaaacatcaagtggtacggcaaggacctcaacaacccgttgggacgcaccgtgatgttaacgggtcaggtcactctcgtctggcctttgtacttag

SEQ ID NO: 15215 - DNA, 355 bp, Artificial
  Mutation in BnaA.FAD2.a introduced by TALE nuclease pair BnFAD2_T02
cctctcctccctcaccctctcccttacctcgcctggcccctctcttgggcctgccagggctgcgtcctaacgggcctctgggtcatcgcccacgaatgcggccaccacgccttcagcgaccacaagtggctggacgacgccgtgggcctagtcttccactccttcctcctcgtcccttacttctcctggaaccatcgacgccaccattccaacactggctccctcgagagagacgaagtgtttgtccccaagaagaagtcagacatcaagtggtacggcaagtacctcaacaaccgttttggacgcaccgtgatgttaacggtacagttcactctcggccggccttagtacttag

SEQ ID NO: 15216 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatggtaacggttcagttcactctcggctggcctttgtacttag

SEQ ID NO: 15217 - DNA, 311 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggcttgacgacaccgtcggtctcatcttccactccttcctcctcgtcccttacttctcctggaatcgtctttgtccccaagaagaaatccgacatcaagtggtacggaaagtacctcaacaacccgctaggacgcacggtgatgctaaccgtccagttcacgctcggctggcctttgtacttag

SEQ ID NO: 15218 - DNA, 347 bp, Artificial
  Mutation in BnaA.FAD2.a introduced by TALE nuclease pair BnFAD2_T02
cctctcctccctcaccctctcccctacttcgcctggcctctctactgggcctgccagggctgcgtcctaaccggcgtctgggtcatcgcccacgagtgcggccaccacgccttcagcgaccaccagtggctggacgacgccgtgggcctcgtcttccactccttcctcctcgtcccttacttctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15219 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggaagcaccgtgatgttaacggttcagttcactctcggctggcctttgtacttag

SEQ ID NO: 15220 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 15221 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 15222 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcctcttccactccttcctcctcgtcccttacttctcctggaatgtcatcgacgccaccattccaacactggctccctcgagagagacgaagtgtttgtccccaagaagaagtcagacatcaagttgtacggcaagttcctcagcaaccctttggtaggcaccgtgattttaacggttcagttcactcgcggctggcctgagtacttag

SEQ ID NO: 15223 - DNA, 347 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15224 - DNA, 423 bp, Artificial
  Mutation in BnaA.FAD2.a introduced by TALE nuclease pair BnFAD2_T02
cctctcctccctcaccctcttccttacctcgcctggaacctctactgggcctgccaaggatgcgtcctaacgggcctctgggtcatcgcccacgaatgcggccaccacgccttcagcgaccaccagtggctggacgacgccgtgggcctcgtcttccactccttcctcctcgtcccttacttctcctggaatagtcttccgactgagcctttcgttttatttgatgcctggcagttccctactctcgcgttcgaatacagcagcgacgccaccattccaacactggctccctcgagagagacgaagtgtttgtccccaagaagaagtcagacatcaagtggtacggcaagtacctcaacaaccctttgggacgcaccgtgatgttaacggtgcatttcactctcggctggcctttgtccttag

SEQ ID NO: 15225 - DNA, 358 bp, Artificial
  Mutation in BnaA.FAD2.a introduced by TALE nuclease pair BnFAD2_T02
cctctcctccctcaccctctcccttacctcgcctggcccctctactgagcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaatagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtatttag

SEQ ID NO: 15226 - DNA, 355 bp, Artificial
  Mutation in BnaA.FAD2.a introduced by TALE nuclease pair BnFAD2_T02
cctctcctccctcaccctctctcctacttcgcgtggcctctctcctgtgcttgccaaggatgcgccctcacaggcgtctgggtcatagcacacgagtgctgccaccacgccatcagcgactaccagtggctggacgacaccgtcgtcctcatcttccactccttcctcctcgtcccttacttctcctggaagcatcgacgccaccattccaacactggctccctcgagagagacgaagtgtttgtccccaagaagaagccagacatcaagtggtacgtcaagtacctcaacatccgtgttggaggcaccgtgattcttacgccccaattcactcccggcgggcctttgtacttag

SEQ ID NO: 15227 - DNA, 306 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcatcgacgccaccattccaacactggctccctcgagagagacgaagtgtttgtccccaagaagaagtcagacatcaagtggtacggcaagtacctcaacaaccctttgggacgcaccgtgatgctaacggttcagttcactctcggctggcctttgtacttag

SEQ ID NO: 15228 - DNA, 389 bp, Artificial
  Mutation in BnaA.FAD2.a introduced by TALE nuclease pair BnFAD2_T02
cctctcctccctcaccctctaacctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacagcaacgtcggttcgagatggcgctcgaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 15229 - DNA, 357 bp, Artificial
  Mutation in BnaA.FAD2.a introduced by TALE nuclease pair BnFAD2_T02
cctctcctccctcaccctctctcctacttcgcctggcctctctacttggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtcgtacggcaaggtcctcaacatcccttgggtacgcaccgtgatgctaacggttcatttcactcgcggccggcctgagtacgtag

SEQ ID NO: 15230 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctcagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 15231 - DNA, 356 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtcatcgacgccaacattccaacactggctccctcgagagagacgaagtgtttgtccccaagaagaagtcagacatcaagtggtacggcaagtacctcaacaaccctttgggacgcaccgtgatgttaacggttcagttcactatcggctggcctttgtacttag

SEQ ID NO: 15232 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatggtaacggttcagttcactctcggctggcctttgtacttag

SEQ ID NO: 15233 - DNA, 352 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggcatcgacgccaccattccaacactggctccctcgagagagacgaagtgtttgtccccaagaagaagtcagacatcaagtggtacggcaagtacctcaacaaccctttgggacgcaccgtgatgttaacgtttcagttcactctcggctggcctttgtacttag

SEQ ID NO: 15234 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgccctaaccggcgtctgggtcatagcccacgagtgcggccaccacgccttcagcgactaccagtggcttgacgacaccgtcggtctcatcttccactccttcctcctcgtcccttacttctcctggaagttcatcgacgccaccattccaacactggctccctcgagagagacgaagtgtttgtccccaagaagaagacagacatcaagtggtacggcaagtacctcagcaagcgttagggacgcatcgtgatgttaaccgttcagttcactctcggctggcctttgtacttag

SEQ ID NO: 15235 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcttttgtactag

SEQ ID NO: 15236 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacaacaagtggtacggcaattacctcaacaaccctttgggacgcaccgtgatgttaacggttcagttcactctcggctggcctttgtacttag

SEQ ID NO: 15237 - DNA, 355 bp, Artificial
  Mutation in BnaA.FAD2.a introduced by TALE nuclease pair BnFAD2_T02
cctctcctccctcaccctctctcctacttcgcctggcctccctcctgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagggatgaagtgttcgtccccaagaagaaatccgacatcaagtggtacggaaagtgcctcaacagcccgctaggacgcacggtgatgctaaccgtccagttcacgctcggctggcctttgtacttag

SEQ ID NO: 15238 - DNA, 357 bp, Artificial
  Mutation in BnaA.FAD2.a introduced by TALE nuclease pair BnFAD2_T02
cctctcctccctcaccctctcccttacctcgcctggactctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcactctcggctggcctgtgtacttag

SEQ ID NO: 15239 - DNA, 363 bp, Artificial
  Mutation in BnaA.FAD2.a introduced by TALE nuclease pair BnFAD2_T02
cctctcctccctcaccctctctcctacttcgcctggcccctctactgggcctgccagggctgcgtcctaaccggcgtctgggtcatagcccacgaatgcggccaccacgccttcagcgaccaccagtggctggacgacgccgtgggcctcgtcttccactccttcctcctcgtcccttacttctcctggaagtacacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 15240 - DNA, 427 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaccgtcaggatggccttctgcttagtttgatgcctggcagtttatggcgggcgtcctccccgcccccctccggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15241 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggtctcatcttccactccttcctcctcgtccattacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15242 - DNA, 337 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcttccacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15243 - DNA, 383 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtttgaccccggagcaggtggtggccagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 15244 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagagactaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15245 - DNA, 439 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtccagcgcctgcttgccaccgccattgctggcgatggccaccacctgctggggggtcaagccgtgggcctggcacagcaccggcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15246 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 15247 - DNA, 348 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggcctcatcttccactccttcctcctcgtcccttacttcttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15248 - DNA, 273 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacaaatgcggccaccacgccatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 15249 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcgtcttccactccttcctcctcgtcccttacttctctcagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 15250 - DNA, 356 bp, Artificial
  Mutation in BnaA.FAD2.a introduced by TALE nuclease pair BnFAD2_T02
cctctcctccctcacactctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15251 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacacagtcatcgacgccaccattccaacactggctccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 15252 - DNA, 372 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttactcaagtcagaggtggcgaaacccgacagtcatcgacgccaccattccaacactggctccctcgagagagacgaagtgtttgtccccaagaagaaatccgacatcaagtggtacggaaagtacctcaacaaccctttgggacgcaccgtgatgttaacggttcagttcactctcggctggcctttgtacttag

SEQ ID NO: 15253 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15254 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacacagtcatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 15255 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtgcctgaacgccaccgtcggcctcatcttccactccttcctcctcgtcccttacttctcctggaagttcatcgacgccaccattccaacactggctccctcgagagagacgaagtgtttgtccccaagaagaagtcatacatcaagtggtacggcaagtacctcaacaaccctttgggacgcaccgtgatgttaacggttcggttcacgctcggctggcctttgtacttag

SEQ ID NO: 15256 - DNA, 468 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcctcttccactccttcctcctcgtcccttacttctcctggagtagcggctgttgccggtgctgtgccaggcccacggcttgaccccccagcaggtggtggccatcgccagcaataatggtggcaagcaggcgctggagacggtccagcggctgtatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15257 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttatcggttcagttctctcccggctggcctttgtacgtag

SEQ ID NO: 15258 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagcagtcagacatcaagtggtacgtcaagtacctcaacaaccctttgggacgcaccgtgatgttaacggttcagttcactctcggctggcctttgtacttag

SEQ ID NO: 15259 - DNA, 355 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15260 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 15261 - DNA, 407 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggaagtacggtgctgttccgggcgatctcgatcagctcgatgtactcgtgggacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15262 - DNA, 357 bp, Artificial
  Mutation in BnaA.FAD2.a introduced by TALE nuclease pair BnFAD2_T02
cctctctccctcaccctctctcctacttcgcctggcctctctactgggcctgccagggctgcgtcctaaccggcgtctgggtcatagcccacgagtgcgtccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15263 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcacacatcgagtggtacggcaagtacctcaacaaccgtttgggacgcaccgtgatgttaacggttcagttcactctcgcctgccctttgcacttag

SEQ ID NO: 15264 - DNA, 363 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15265 - DNA, 360 bp, Artificial
  Mutation in BnaA.FAD2.a introduced by TALE nuclease pair BnFAD2_T02
cctctcctccctcaccctctctcctacttcgcctggcctctctactgggcctgtcaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtacgtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 15266 - DNA, 356 bp, Artificial
  Mutation in BnaA.FAD2.a introduced by TALE nuclease pair BnFAD2_T02
cctctcctccctcaccctctctcctacttcgcctagccactctcctaggcctcccaacactgcgtcctaaccggcgtccgggtcatcgcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaaccgtacagtgcacgcccgcctggcccttgtccctag

SEQ ID NO: 15267 - DNA, 294 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggcctcatcttccactccttcctccttgtcaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15268 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacgtag

SEQ ID NO: 15269 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacctgcgtctgggtcatagcccacgagtgcggccaccacgccttcagcgactaccagtggctggacgacaccgtcggcctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15270 - DNA, 363 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttatcagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15271 - DNA, 400 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccaagagtgcggccaccacgccttcagcgactaccagtggctggacgacaccgtcggcctcatcttccactccttcctcctcgtcccttacttctcctggaagtaaccgcctctccccgcgcgttggcacgacaggtttcccgacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15272 - DNA, 387 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtccctttgcctggcacagcaccggcaacagccgctggaccgtctccagctgtcatcgacgcaaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttaa

SEQ ID NO: 15273 - DNA, 358 bp, Artificial
  Mutation in BnaA.FAD2.a introduced by TALE nuclease pair BnFAD2_T02
cctctcctccctcaccctctcccttacctctcctgtcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtttcatcgacgccaccattccaacactggctccctcgagagagacgaagtgtttgtccccaagaagaagtcagacatcaagtggtacggcaagtacctcaacacccctttgggacgcaccgtgatgttaacagttcagttctctctcggctggcctttgtacttag

SEQ ID NO: 15274 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15275 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgccaccgtcggcctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15276 - DNA, 357 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15277 - DNA, 423 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttactttccagcgcctgcttgccgccatcgtggctggcgatggccaccacctgctggggggtcaagccgtgggcctggcacagtcatcgacgccaccattccaacaccggatccctcgagagggatgaagtgttcgtccccaagaagaaatcagacatcaagtggtacggaaagtacctcaacaacccgctaggacgcacggtgatgctaaccgtccagttcacgctcggctggcctttgtacttag

SEQ ID NO: 15278 - DNA, 360 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15279 - DNA, 372 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgaatgcggccaccacgccttcagcgactaccagtggcttgacgacaccgtcggtctcatcttccactccttcctcctcgtcccttactcaagtcagaggtggcgaaacccgacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15280 - DNA, 344 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttcctcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcatttgtacttag

SEQ ID NO: 15281 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaaatccgacatcaagtggtacggcaagtacctcaacaaccctttgggacgcaccgtgatgttaacggttcagttcactctcggctggcctttgtacttag

SEQ ID NO: 15282 - DNA, 355 bp, Artificial
  Mutation in BnaA.FAD2.a introduced by TALE nuclease pair BnFAD2_T02
cctctcctcctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcatggtgatgctaaccgtccagttcacgctcggctggcctttgtacttag

SEQ ID NO: 15283 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15284 - DNA, 357 bp, Artificial
  Mutation in BnaA.FAD2.a introduced by TALE nuclease pair BnFAD2_T02
ccctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 15285 - DNA, 357 bp, Artificial
  Mutation in BnaA.FAD2.a introduced by TALE nuclease pair BnFAD2_T02
ccctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15286 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcctctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 15287 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgctgccaccacgccttcagcgaccaccagtggctggacgacgccgtgggcctcgtcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggaagcaccgtgaggttaacggttcagttcactctcggctggcctttgtacgtag

SEQ ID NO: 15288 - DNA, 344 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggacaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15289 - DNA, 351 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15290 - DNA, 395 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagccgccggagtaggccttggtgtccacgatcacgccgtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15291 - DNA, 357 bp, Artificial
  Mutation in BnaA.FAD2.a introduced by TALE nuclease pair BnFAD2_T02
cctctcctccctctccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcacacatctagtggtacggcaagtacctcaacaaccctttgggacgcaccgtgatgttaacggttcagttcactctcggctggcctttgtacttac

SEQ ID NO: 15292 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagggatgaagtgtttgtccccaagaagaagtcagacatcaagtggtacggcaagtacctcaacaaccctttgggacgcaccgtgatgttaacggttcagttcactctcggctggccttgtacttag

SEQ ID NO: 15293 - DNA, 345 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtggtcctcgtcttccactccttcctcctcgtcccttacttcatcgacgccaccattccaacactggctccctcgagagagacgaagtgtttgtccccaagaagaagtcagacatcaagtggtactgcaagtacctcaacaaccctttgagacgcaccgtgatgttaaccgttcagttcactctcggctggcctttgtacttat

SEQ ID NO: 15294 - DNA, 400 bp, Artificial
  Mutation in BnaA.FAD2.a introduced by TALE nuclease pair BnFAD2_T02
cctctctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagaatgattttattttgactgatagtgacctgttcgttgcaacaaattcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15295 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 15296 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacaccttcagcgactaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15297 - DNA, 321 bp, Artificial
  Mutation in BnaA.FAD2.a introduced by TALE nuclease pair BnFAD2_T02
cctctctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 15298 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacacccctttgggacgcaccgtgatgttaacggttcagttctctctcggctggcctttgtacttag

SEQ ID NO: 15299 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggatacagtcatcgacgccaccattccaacactggctccctcgagagagacgaagtgtttgtccccaagaagaagacagacatcaagtggtacggcaagtacctcaacaaccctttgggacgcaccgtgatgttaacggttcagttcactctcggctggcctttgttag

SEQ ID NO: 15300 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggatacagtcatcgacgccaccattccaacactggctccctcgagagagacgaagtgtttgtccccaagaagaaggcagacatcaagtggtacggcaagtacctcaacaaccctttgggacgaaccgtgatgttaacggttcagttcactctcggctggcctttgttag

SEQ ID NO: 15301 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcctctgggtcatcgcccacgaatgcggccaccacgccttcagcgaccaccagtggctggacgacgccgtgggcctcgtcttccactccttcctcctcgtcccttacttctcctggaaaccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 15302 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgatgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15303 - DNA, 413 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacaatggccaccacctgctggggggtcaagccgtgggcctggcacagcaccggcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15304 - DNA, 372 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttactcaagtcagaggtggcgaaacccgacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15305 - DNA, 340 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtccctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15306 - DNA, 392 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtgggcctggcacagcaccggcaagcaggcgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15307 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgccctaaccggcgtctgggtcatagcccacgagtgcgtccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacagccctttgggacgcaccgtggtgttaacggttcagttcactctcggctggcctttgtacttaa

SEQ ID NO: 15308 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttctcctggaagtcagtcatcgacgccaccattccaacactggctccctcgagagagacgaagtgtttgtcccaagaagaagtcagacatcaagtggtacggcaagtacctcaacaaccctttgggacgcaccgtgatgttaacggttcagttcactctcggctggcctttgtacttag

SEQ ID NO: 15309 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctcaccggcgtctgggtcatagcccacgagtgcggccaccacgccttcagcgaccaccagtggctggacgacgccgtgggcctcgtcttccactccttcctcctcgtcccttacttctcctggaagtatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15310 - DNA, 339 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctggctcatagcccacgagtgcggccaccacgccttcagcgactaccagtggctggacgacaccgtcggcctcatcttccactccttcctcctcgtcccttacttctccaccatttcaacactggcttcctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 15311 - DNA, 294 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactcctccctccttgtcaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15312 - DNA, 346 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagcaggcaatccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15313 - DNA, 389 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacagcaacgtcggttcgagatggcgctcgaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15314 - DNA, 310 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtcatcgacgccaccattccaacactggctccctcgagagagacgaagtgtttgtccccaagaagaagtcagacatcaagtggtacggcaagtatctcaacaacccgctaggacgcacggtgatgctaaccgtccagttcacgctcggctggcctttgtacttag

SEQ ID NO: 15315 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 15316 - DNA, 456 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtacaaacaacgcggcgagctttgatcaacgaccttttggaaacttcggcttccccttaacgcaggaaagaacatgtgagcaaaaggccagcaaaaggcagtcagcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15317 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactgag

SEQ ID NO: 15318 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagcacctcaacaaccctttgggacgcaccgtgatgttaacggttcagttcactctcggctggcctttgtacttag

SEQ ID NO: 15319 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggactcgtcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15320 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15321 - DNA, 439 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgccggtgctgtgccaggcccacggcttgaccccggagcaggtggtggccatcgccagccacgatggcggcaagcaggcgcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15322 - DNA, 350 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15323 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgaatgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15324 - DNA, 323 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtaccgctcgccgcagccgaacgaccgagaagaagtcagacatcaagtggtacggcaagtacctcaacaaccctttgggacgcaccgtgatgttaacggttcagttcactctcggctggcctttgtacttag

SEQ ID NO: 15325 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagaaagtcatcgacgccaccattccaacactggctccctctagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15326 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacgccgtgggcctcgtcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15327 - DNA, 345 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15328 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggccccctcgagagagacgaagtgtttgtccccaagaagaagtcagacatcaagtggtacggcaagtacctcaacaaccctttgggacgcaccgtgatgttaacggttcagttcactctcggctggcctttgtacttat

SEQ ID NO: 15329 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaataagtcagacatcaagtggtacggcaagtacctcaacaaccctttgggacgcaccgtgatgttaacggttcagttcactctcggctggcctttgtacttag

SEQ ID NO: 15330 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaacccgctaggacgcacggtgatgctaacggttcagttcactctcggctggcctttgtacttag

SEQ ID NO: 15331 - DNA, 355 bp, Artificial
  Mutation in BnaA.FAD2.a introduced by TALE nuclease pair BnFAD2_T02
cctctcctccctcaccctctctcctacttcgcctggcccctctactgggcctgcccgggccgcgccctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagccacacatcaagtggtacggcaagtccctcagcaaccgtgtgggacgcacagtggagttaacggctcagttcaccctcggctggcctttgtacttag

SEQ ID NO: 15332 - DNA, 322 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtcggcctcatcttccactccttcctcctcgtcccttacttctcctggaagtaccgctcgccgcagccgaacgaccgagaagaagtcagacatcaagtggtacggcaagtacctcaacaaccctttgggacgcaccgtgatgttaacggttcagttcactctcggctggccttgtacttag

SEQ ID NO: 15333 - DNA, 399 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtagccgaagtttccaaaaggtcgttgatcaaagctcgccgcgttcatcgacgccacaattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15334 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacaccggatccctcgagagggatgaagtgttcgtccccaagaagaagtcagacatcaagtggtacggcaagtacctcaacaacccgctaggacgcacggtgatgctaaccgtccagttcacgctcggctggcctttgtacttag

SEQ ID NO: 15335 - DNA, 344 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacaccgtcggcctcatcttccactccttcctcctcgtcccttcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 15336 - DNA, 348 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctccttcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15337 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15338 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgccctaaccggcgtctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaagtcagacatcaagtggtacggcaactacctcaacgaccctgttggacgcaccgtgaggttaacggttcaattcactcccggcgggcctttgtacttaa

SEQ ID NO: 15339 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaatcgacgccaccattccaacactggctccctcgagagagacgaagtgtttgtccccaagaagaagtcagacatcaagtcgtacgtcatgtacctcaacaacccttgggtatgcaccgtgatcttaacggttccgttcactctcggctggcctttgtacttag

SEQ ID NO: 15340 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccatgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15341 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggacaccacgccttcagcgactaccagtggcttgacgacaccgtcggtctcatcttccactccttcctcctcgtcccttacttctcctggaaagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 15342 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaacagtcatcgacgccaccattccaacactggctccctcgagagagacgaagtgtttgtccccaagaagaagtcagccatcaagtggtacggcaagtacctcaacaaccctttgggacgcaccgtgatgttaacggttcagttcactctcggctggcctttgtacttag

SEQ ID NO: 15343 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacacgggctccctcgagagagacgaagtgtttgtccccaagaagaagtcagacatcaagtggtacggcaagtacctcaacaaccctttgggacgcaccgtgatgttaacggttcagttcactctcggctggcctttgtacttat

SEQ ID NO: 15344 - DNA, 355 bp, Artificial
  Mutation in BnaA.FAD2.a introduced by TALE nuclease pair BnFAD2_T02
ccttcctacctcaccctctctcctacttcgcctggcctctctactgggcctgccaagggtgcgtcctaaccggcgtctgggtcatagcccacgagtgcggccaccacgccttcagcgccttccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15345 - DNA, 352 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 15346 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcatcaaccctttgggacgcaccgtgatgttaacggttcagttcactctcggctggcctttgtacttag

SEQ ID NO: 15347 - DNA, 344 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15348 - DNA, 336 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15349 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcatttgtacttag

SEQ ID NO: 15350 - DNA, 343 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttactatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15351 - DNA, 418 bp, Artificial
  Mutation in BnaA.FAD2.a introduced by TALE nuclease pair BnFAD2_T02
cctctcctccctcaccctctctcctacttcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaggggaagccgaagtttccaaaaggtcgttgatcaaagctcgccgcgttgtttcatcaagcccatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 15352 - DNA, 365 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtaactacagtcatcgacgccaccattccaacactggctccctcgagagagacgaagtgtttgtctccaagaagaagtcagacatcaagtggtacgtcaattcctcgaccacgcctgatgtacgtacggtgctgtctcccctccagttccctctcggctggcctttgtacttag

SEQ ID NO: 15353 - DNA, 393 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggagactgagcctttcgttttatctgttgtttgtcggtgaacgctcgccagcaaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15354 - DNA, 352 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15355 - DNA, 312 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 15356 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacacccctttgggacgcaccgtgatgttaacggttcagttcactctcggctggcctttgtacttag

SEQ ID NO: 15357 - DNA, 345 bp, Artificial
  Mutation in BnaA.FAD2.a introduced by TALE nuclease pair BnFAD2_T02
cctctcctccctcaccctctctcctacttctcctggcctctctactgggcctgccaagggcgcgtcctaaccggcgtctgggtcatcgcccacgagtgcggccaccacgccttcagcgaccaccagtggctggacgacgccgtgggcctcgtcttccactccttcctcctcgtcccttacttctcctacgccaccattccaacactggctccctcgagagagacgaagtgtttgtccccaagaagaagtcagacatcaagtggtacggcaagtacctcaccacccctgtgggacgcacggggatgctaaccgtccagctcacgctcggctggcctttgtacttag

SEQ ID NO: 15358 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 15359 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 15360 - DNA, 319 bp, Artificial
  Mutation in BnaA.FAD2.a introduced by TALE nuclease pair BnFAD2_T02
cctctcctccctcaccctctctcctacttcgcctggcccctctactgggcctgccagggctgcgtcctaaccggcgtctgggtcatagcccacgagtgcggccaccacgccttcagcgactaccagtggcttgacgacaccgtcggtctcatcttccactccttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15361 - DNA, 324 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagctaccaccagtggctggacgacgccgtgggcctcgtcttccactccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15362 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctgatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15363 - DNA, 321 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15364 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 15365 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15366 - DNA, 352 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15367 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctctagagagacgaagtgtttgtccccaagaagaagtcagacatcaagtggtacggcaagtacctcaacaacccttttggacgcaccgtgatgttaacggttcagttcactctcggctggcctttgtacttag

SEQ ID NO: 15368 - DNA, 349 bp, Artificial
  Mutation in BnaA.FAD2.a introduced by TALE nuclease pair BnFAD2_T02
cctctcctccatcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttccgtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 15369 - DNA, 387 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggccccccagcaggtggtggccatcgccagcaatagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15370 - DNA, 356 bp, Artificial
  Mutation in BnaA.FAD2.a introduced by TALE nuclease pair BnFAD2_T02
cctctcctccctcaccctctcccttacctcgccttgcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15371 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15372 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15373 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 15374 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaatccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15375 - DNA, 357 bp, Artificial
  Mutation in BnaA.FAD2.a introduced by TALE nuclease pair BnFAD2_T02
cctctcctccctcaccctctctcctacttcgcctggcctctctactgggactgccagggctgcgtcctaaccggcgtctgggtcctagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15376 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaaacatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggccctttgtacttag

SEQ ID NO: 15377 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcagcctcatcttccactccttcctcctcgtcccttacttctcctggaacagtcatcgacgccaccattccaacactggctccctcgagagagacgaagtgtttgtccccaagaagaagtcagacatcaagtggttcggcaagtacctcagcaaccctttgggacgcaccgtgatgttaacggttcagttcactctcggctggcctttgtacttag

SEQ ID NO: 15378 - DNA, 364 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtattacagtcatcgacgccaccattccaacactggctccctcgagagagacgaagtgtttgtccccaagaagaagtcagacatcaagtggtacggcaagtgcctcaacaaccctttgggacgcaccgtgatgttaacggttcagttcactctcggctggcctttgtacttag

SEQ ID NO: 15379 - DNA, 388 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaggcctttttacggttcctggccttttgcgtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15380 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcacagtgatgttaacgtttcagttcactctcggctggcctttgtacttag

SEQ ID NO: 15381 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcaactaccagtggctggacgacgccgtgggcctcgtcttccactccttcctcctcgtcccttacttctcctggaagtatacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15382 - DNA, 359 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15383 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15384 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcccatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 15385 - DNA, 352 bp, Artificial
  Mutation in BnaA.FAD2.a introduced by TALE nuclease pair BnFAD2_T02
cctctcctccctcaccctctctcctacttcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15386 - DNA, 357 bp, Artificial
  Mutation in BnaA.FAD2.a introduced by TALE nuclease pair BnFAD2_T02
cctctccttcctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccacgaacaagtctgacctcacgtcgtacggcaagtacctcaacatcccttcgggacgcaccgtgatgttaacggttcagttcactcccggctggcctttgtacttag

SEQ ID NO: 15387 - DNA, 357 bp, Artificial
  Mutation in BnaA.FAD2.a introduced by TALE nuclease pair BnFAD2_T02
cctctccttcctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtcgtactgcaagtaccccaacaaccctttgggacgcaccgtgatgttaacggttcagttccctctcggctggcctttgtacttag

SEQ ID NO: 15388 - DNA, 448 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacaccgtcggcctcatcttccactccttcctcctcgtcccttacttctccgtggcggcgtgaccgcagtggaggcagtgcatgcatggcgccgatctacgcacgctcggctacagccagcagcaacaggagaagatcaaaccgaaggttcatcgacgccaccattccaacactggctccctcgagagagacgaagtgtttgtccccaagaagaagtcagacatcaagtggtacggcaagtacctcaacaaccctttgggacgcaccgtgatgttaacggttcggttcactctcggctggcctttgtacttag

SEQ ID NO: 15389 - DNA, 391 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgggcctggcacagcaccggcaacagccgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15390 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15391 - DNA, 322 bp, Artificial
  Mutation in BnaA.FAD2.a introduced by TALE nuclease pair BnFAD2_T02
cctctccccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccgctcgccgcagccgaacgaccgagaagaagtcagacatcaagtggtacggcaagtacctcaacaaccctttgggacgcaccgtgatgttaacggttcagttcactctcggctggcctttgtacttag

SEQ ID NO: 15392 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacatag

SEQ ID NO: 15393 - DNA, 355 bp, Artificial
  Mutation in BnaA.FAD2.a introduced by TALE nuclease pair BnFAD2_T02
cctctcctccctaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagccagacatcaagtggtacggcaagtacctcaacatccctttgggccgcaccgtgctgttcacggttcagttcactctcggctggcctttgtactcag

SEQ ID NO: 15394 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgcccaccagtggctggacgacgccgtgggcctcgtcttccactccttcctcctcgtcccttacttctcctggaagtcatcgacgccaccattccaaccctggctccctcgagagagacgaagtgtttgtccccaagaagaagtcagacatcaagtggtacgacaagtacctcaacaaccctttgggacgcaccgtgatgttaacggttcagttcactctcggctggcctttgtacttag

SEQ ID NO: 15395 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgtggccaccacgccttcagcgaccaccagtggctggacgacgccgtgggcctcgtcttccactccttcctcctcgtcccttacttctcctggaactcatcgacgccaccattccaacactggctccctcgagagagacgaagtgtttgtccccaagaagaagtcatacatcaagtggtacggcaagtacctcaacaaccctttgggacgcaccgtgatgttaacggttcagttcactctcggctggcctttgtacttag

SEQ ID NO: 15396 - DNA, 356 bp, Artificial
  Mutation in BnaA.FAD2.a introduced by TALE nuclease pair BnFAD2_T02
cctctactccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15397 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaaccatcgacgccaccattccaacaccggatccctcgagagggatgaagtgttcgtccccaagaagaaatcccacatcaagtgttacggaaagtacctcaacaacccgctaggacgcacggtgattctaacggttcagttcacgcccggctggcctttgtgcttag

SEQ ID NO: 15398 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 15399 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcatcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15400 - DNA, 389 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggctggacgacaccgtcggcctcatcttccactccttcctcctcgtcccttacttctcctggaagtatggtggccatcgccagcaatggcggtgacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15401 - DNA, 342 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgaccaccagtggctggacgacgccgtgggcctcgtcttccactccttcctcctcgtccctgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15402 - DNA, 353 bp, Artificial
  Mutation in BnaA.FAD2.a introduced by TALE nuclease pair BnFAD2_T02
ccttcctccctcaccctctctcctacttcgcctggcctctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttctcctggaagatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15403 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtcatcgatgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15404 - DNA, 358 bp, Artificial
  Mutation in BnaA.FAD2.a introduced by TALE nuclease pair BnFAD2_T02
cctctcctcactcaccctctctcctacttcgcctggcctctctactgggcctgccagggctgcgtcctaaccggcgtctgggtcatagcccacgagtgcggccaccacgccttcagcgactaccaggggctggacgacaccgtcggcctcatcttccactccttcctcctcgtcccttacttctcctggaacagtcatcgacgccaccattccaacactggctccctcgagggagacgaagtgtttgtccccacgaagaagtcagacatccacttttacggcaagtacctcaacatcccgctagctcgcccggtgatgctaaccgtccagttcacgctcgcctagcatttatacttag

SEQ ID NO: 15405 - DNA, 351 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggcctcatcttccactccttcctcctcgtcccttacttctcctggatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15406 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacgacgccaccattccaacactggctccctcgagagagacgaagtgtttgtccccaagaagaaggcagacataaagtggtacggcaagtacctcaacaaccctttgggacgcaccgtgatgttaacggttcagttcactctcggctggcctttgtacttag

SEQ ID NO: 15407 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacaccttcagcgactaccagtggctggacgacaccgtcggcctcatcttccactccttcctcctcgtcccttactaacagtcatcgacgccaccattccaacactggctccctcgagagagacgaagtgtttgtccccaagaagaagccagacatcaagtagtacggcaagtacctcaacaaccctttgggacgcaccgtgatgttaacggttcagttcactctccgctggcatttgcacttat

SEQ ID NO: 15408 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15409 - DNA, 354 bp, Artificial
  Mutation in BnaA.FAD2.a introduced by TALE nuclease pair BnFAD2_T02
cctctcctccctcaccctctctcctacctcgcctggcccctctactgggcctgccaaggctgcgtcctaacgggcctctgggtcatcgcccacgaatgcggccaccacgccttcagcgaccaccagtggctggacgacgccgtcggtctcatcttccactccttcctcctcgtcccttacttctcctggagcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15410 - DNA, 357 bp, Artificial
  Mutation in BnaA.FAD2.a introduced by TALE nuclease pair BnFAD2_T02
cctctcctccctcaccctctctcctacttcttctggcctctctactgtgcttgccatgtctgcgtcctcacgggcctctgggtcatcgcccacgaatgcgtccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtagcccaaaacgcctgagggacgcaaggtgatgcctacccttccgctccctctcggctggcctttgtacttag

SEQ ID NO: 15411 - DNA, 357 bp, Artificial
  Mutation in BnaA.FAD2.a introduced by TALE nuclease pair BnFAD2_T02
cctctactccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttcatcgacgccaccattccaacactggctccctcgagagagacgaagtgtttgtccccaagaagaagtcagacatcaagtggtacggcaagtacctcaacatccctttgggacgcaccgtgatgttaacggttcagttcactctcggctggcctttgtacttag

SEQ ID NO: 15412 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgactaccagtggctggacgacaccgtcggcctcatcttccactccttcctcctcgtcccttacttctcctggaaggtcatcgacgccaccattccaacactggctccctcgagagggatgaagtgttcgtccccaagaagaaatccgacatcaagtggtacggcaagtacctcaacaaccctttgggacgcaccgtgatgttaacggttcagttcacgctcggctggcctttgtacttag

SEQ ID NO: 15413 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaaggatcgacgccaccattccaacactggctccctcgagagagacgaagggtttgtccccaagaagaagtcagacatcaagtggtacggcaagtacctcaacaaccctttgggacgcaccgtgatgttaacggttcagttcactctcggctggcctttgtacttag

SEQ ID NO: 15414 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctctcagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15415 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctgttggacgcacggtgatgttaaccgttcagttccctctcggctggcctttgtacttag

SEQ ID NO: 15416 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcctcttccactccttcctcctcgtcccttacttctcctggaagtaagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 15417 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15418 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15419 - DNA, 339 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctccaccatttcaacactggcttcctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15420 - DNA, 417 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtcttggtcatagcccacgagtgcggccaccacgccttcagcgactaccagtggctggacgacaccgtcggcctcatcttccactccttcctcctcgtcccttacttctcctggaagtggagcggatttgtcctactcaggagagcgttcaccgacaaacaacagataaaacgaaaagtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 15421 - DNA, 273 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacaaatgcggccaccacgccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15422 - DNA, 344 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttactcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15423 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggatctacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15424 - DNA, 360 bp, Artificial
  Mutation in BnaA.FAD2.a introduced by TALE nuclease pair BnFAD2_T02
cctctcctccctcaccctctctcctacttcttctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagaaagtcatcgacgccaccattccaacactggctccctcgagagagacgaagtgtttgtccccaagaagaagtcagacatcaagtggtacggcaagtaccccaacacccctttgggacgcacggggatgtcaacggttcagttcactctcggctggcctttgtacttag

SEQ ID NO: 15425 - DNA, 389 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacagcaacgtcggttcgagatggcgctcgaagtcatcgacgccaccattccaacactggctccctcgagagagacgaagtgtttgtcaccaagaagaagtcagccatcatgtggtacggcaagtacctcaacaaccctttgggacgcaccgtgatgttaacggttcagttcactcgcggctggcatttgtacttag

SEQ ID NO: 15426 - DNA, 441 bp, Artificial
  Mutation in BnaA.FAD2.a introduced by TALE nuclease pair BnFAD2_T02
cccctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtgccaggcccacggcttgaccccccagcaggtggtggccatcgccggccagcaacgtcggttcgagatggcgctcgatgacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 15427 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 15428 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccccttgggacgcaccgtgatgttaacggttcagttcactctcggctggcctttgtacttag

SEQ ID NO: 15429 - DNA, 385 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgactaccagtggctggacgacaccgtcggcctcatcttccactccttcctcaagccgtgggcctggcacagcaccggcaacagccgctggaccgtctccagctgtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 15430 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtcggtctcatcttccactccttcctcctcgtcccttacttctcctggaagtcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcgtctggcctttgtacttag

SEQ ID NO: 15431 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctgcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15432 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcgtcctcatcttccactccttcctcctcgtcccttacttctcctggaagtcatcgacgccaccattccaacactggctccctcgagagagacgaagtgtttgtccccaagaagaagtcagacatcgagtggtacggcaagtacctcaacaaccctttggaacgcaccgtgatgttaacggttcagttcactcgcggctggcctttgtacttag

SEQ ID NO: 15433 - DNA, 355 bp, Artificial
  Mutation in BnaA.FAD2.a introduced by TALE nuclease pair BnFAD2_T02
cctctcctccctccccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacatccctttgggacgcaccgttatggtaacggttcagttcactctcggcgggccttggtacttag

SEQ ID NO: 15434 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 15435 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgatgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15436 - DNA, 365 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtaggcctcgtcttccactccttcctcctcgtcccttacttcctcctcgtcccttacttctcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 15437 - DNA, 365 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgaccccgtgggcctcgtcttccactccttcctcctcgtcccttacttcctcctcgtcccttacttctcatcgacgccaccattccaacaccggatccctcgagagggatgaagtgttcgtccccaagaagaagtcagacatcaagtggtacggcaagtacctcaacaaccctgtgggacgcaccgtgatgttaacggttcagttcactctcggctggcctttgtacttag

SEQ ID NO: 15438 - DNA, 348 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttcttcatcgacgccaccattccaacaccggatccctcgagagggatgaagtgttcgtccccaagaagaaatcagacatcaagtggtacggcaagtacctcaacaaccctttgggacgcaccgtgatgttaacggttcagttcactctcggctggcctttgtacttag

SEQ ID NO: 15439 - DNA, 395 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttgaccccccagcaggtggtggccatcgccagccaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15440 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15441 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctccttcatcgacgccaccattccaacactggctccctcgagagagacgaagtgtttgtccccaagaagaagtcagacatcaagtggtacggcaagtacctcaacaaccctttgggacgcaccgtgatgttaacggttcagttctctctcggctggcctttgtacttag

SEQ ID NO: 15442 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgccctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtcgtccgtcaagtccctcaccaccccttttgtacgcaccttgctgttaccccttcagttccctctcggctggcctttgtacttag

SEQ ID NO: 15443 - DNA, 353 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctccttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15444 - DNA, 443 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctgcgatcgccaccacctgctggggggtcaagccgtgggcctggcacagcaccggcaacagccgctggaccgtctccagcgcctgcttgtgcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15445 - DNA, 405 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatgttgccaccgccattgctggcgatggccaccacctgctggggggtcaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15446 - DNA, 358 bp, Artificial
  Mutation in BnaA.FAD2.a introduced by TALE nuclease pair BnFAD2_T02
cctctcctccctcaaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttcccctccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15447 - DNA, 351 bp, Artificial
  Mutation in BnaA.FAD2.a introduced by TALE nuclease pair BnFAD2_T02
cctctcatccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15448 - DNA, 408 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggccatagcccacgagtgcggccaccacgccttcagcgactaccagtggctggacgacaccgtcggcctcctcttccactccttcctcctcgtcccttacttctcctggaagtaccggtgctgtgccaggcccacggcttgaccccccagcaggtggtggccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15449 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 15450 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctcaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctgtgggacgcgccgtgatggtagcggttcagttcactctcggctggcctttgtacttag

SEQ ID NO: 15451 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15452 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctgtgggacgcaccgggatgttaacggttcagttcactctcggctggcctttgtacttag

SEQ ID NO: 15453 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctgaaaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15454 - DNA, 356 bp, Artificial
  Mutation in BnaA.FAD2.a introduced by TALE nuclease pair BnFAD2_T02
cctctcctccctcaccctctcccttacctcgcctggtccctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15455 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactgag

SEQ ID NO: 15456 - DNA, 357 bp, Artificial
  Mutation in BnaA.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15457 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtcttggtcatagctcacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15458 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15459 - DNA, 340 bp, Artificial
  Mutation in BnaA.FAD2.a introduced by TALE nuclease pair BnFAD2_T02
cctctccccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15460 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactgactccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15461 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcgagtggtccggcaagtaccccaacaacccttttggacgcacggtgaagttaacggtccagttcactctcggctggcctttgtacttag

SEQ ID NO: 15462 - DNA, 291 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccatcagcgactaccagtggcttgacgacaccgtcggaagactggctccctcgagagagacgaactgtttgtccccaagaagaagtcagacatcaagtggtacggcaagtacctcaacaaccctttgggacgcaccgtgatgttaacggttcagttcactctcggctggcctttgtacttag

SEQ ID NO: 15463 - DNA, 394 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtattgagtgagctgataccgctcgccgcagccgaacagtcatcgacgccaccattccaacactggctccctcgagggagacgaagtgtttttccccaagaagaagtcagacatcaagtggttcggcaagtacctcaacaaccctttgggacgcaccgtgatgttaacggttcagttcactctcggctggcctttgtacttag

SEQ ID NO: 15464 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 15465 - DNA, 419 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtactggaccgtctccagcgcctgcttgaaagataccaggcgtttccccctggaagctccctcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttgtacttag

SEQ ID NO: 15466 - DNA, 348 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcaccgaccaccagtggctggacgacgccgtgggcctcgtcttccactccttcctcctcgtcccttacttagtcatcgacgccaccattccaacactggctccctcgagagagcctaagtgtttgtccccaagaagaagtcagacatcaagtgtttcggcaagtacctcaacaaccctctggaacgccccgtgattttaacggttcagttcactcgcccccgcccttagcacctag

SEQ ID NO: 15467 - DNA, 312 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15468 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 15469 - DNA, 318 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggggagagacgaagtgtttgtccccaagaagaagtcagacatcaagtggtacggcaagtacctcaacaaccctttgggacgcaccgtgatgctaaccgtccagttcacgctcggctggcctttgtacttag

SEQ ID NO: 15470 - DNA, 383 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtttgaccccggagcaggtggtggccagtcatcgacgccaccattccaacactggctccctcgagagagacgaagtgtttgtccccaagaagaagtcagacatcaagtggtacggcaagtacctcaacagccctttgggacgcaccgtgatgttaacggttcagtgcagtctcgcgtggcatgggtacgtgg

SEQ ID NO: 15471 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtaggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacacccctttgggacgcaccgtgatgttaacggttcagttcactctcggctggcctttgtacttag

SEQ ID NO: 15472 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaattcatcgacgccaccattccaacactggctccctcgagagatacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15473 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacgccgtgggcctcgtcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 15474 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcatccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15475 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctgcatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 15476 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcatttcactctcgcctggcctttgtacttag

SEQ ID NO: 15477 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgccaccgtcgccctcatctaccactccttcctcctcgtcatcgacgccaccattccaaccctggctccctcgagagagacgaagtgtttgtccccaagaagaagtcagacatcaactggtccgacaagtacctcaacaaccctttggaacgcacagtgatgttaacggttcagttcactctcgcctggcattagtacttag

SEQ ID NO: 15478 - DNA, 387 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtccctttgcctggcacagcaccggcaacagccgctggaccgtctccagctgtcatcgacgcaaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 15479 - DNA, 318 bp, Artificial
  Mutation in BnaA.FAD2.a introduced by TALE nuclease pair BnFAD2_T02
cctctcctccctcaccctctctcctacttcgcctggcctctctactgggcctgccagggctgcatcctaaccggcgtctgggtcatagcccacgagtgcggccaccacgccttcagcgactaccagtggctggacgacaccgtcggcctcatcttccactccttcctcctcgtcccttacttctcctggagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 15480 - DNA, 334 bp, Artificial
  Mutation in BnaA.FAD2.a introduced by TALE nuclease pair BnFAD2_T02
cctctcctccctccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15481 - DNA, 360 bp, Artificial
  Mutation in BnaA.FAD2.a introduced by TALE nuclease pair BnFAD2_T02
cctctcctccctcaccctctctcctacttcgcctggcctctctacttggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggcagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 15482 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttccgcgactaccagtggcttgacgacaccgtcggtctcatcttccactccttcctcctcgtcccttacttctcctggaaagtcatcgacgccaccattccaacactggctccctcgagagggatgaagtgttcgtccccaagaagaaatcccacatcaagtggtacggaaagtacctcaacaacccgctaggacgcacggtgatgctaaccgtccagttcacgcgcggctggcctgtgtacttag

SEQ ID NO: 15483 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15484 - DNA, 353 bp, Artificial
  Mutation in BnaA.FAD2.a introduced by TALE nuclease pair BnFAD2_T02
cctctctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcgggccttagtacttag

SEQ ID NO: 15485 - DNA, 407 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtacggtgctgttccgggcgatctcgatcagctcgatgtactcgtgggacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15486 - DNA, 362 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctagtcccttacttctcctggaagttacagccatcgacgccaccattacaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 15487 - DNA, 332 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15488 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtaatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 15489 - DNA, 344 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggacaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15490 - DNA, 332 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 15491 - DNA, 364 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagttacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15492 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccctggctgcgtcctcaccggcgtctgggtcatcgcccccgattgcggccaccacgccttcagcgactaccagtggctagacagccccatcggcctcatcttccactccttcctcctcgtcccttacttctcctagaagtcctcgacgcccccattccaacactggcgccctcgagagagacgaagtgtttgtccccaagaagaagtcagacatcaagtggtacggcaagtacctcaacaaccctttggcacgcaccttgatgttaacggttcagttcactctcgcctggcctttgtactgat

SEQ ID NO: 15493 - DNA, 413 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggacaggcccacggcttgaccccccagcaggtggtggccatcgccagcaatggcggtggcagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15494 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtgcttag

SEQ ID NO: 15495 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcaaacatcaagtggtacggcaagtacctcaacaaccctttgggacgcaccgtgatgttaacggttcaattcactctcggctggcctttgtgcttag

SEQ ID NO: 15496 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttaa

SEQ ID NO: 15497 - DNA, 318 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggactcatcttccactccttcctcctcgtcccttacttctcctggagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15498 - DNA, 354 bp, Artificial
  Mutation in BnaA.FAD2.a introduced by TALE nuclease pair BnFAD2_T02
ctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15499 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaagtcatcgacgccaccattccaacactggctccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 15500 - DNA, 358 bp, Artificial
  Mutation in BnaA.FAD2.a introduced by TALE nuclease pair BnFAD2_T02
cctctcctccctctccctctctcctacttcgcctggcctctctactgggcctgccaagggtgcgtcctaaccggcgtctgggtcatagcccacgagtgcggccaccacgccttaagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15501 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttccgtcatcgacgccaccattccaacactggctccctcgagagagacgaagtgtttgtccccaagaagaagtcagacatcaagtggtacggcaagtacctcaacaaccctgtgggacgcgtcgtgatggtatcgggtcaggtctctctcggctgccctttgtacttag

SEQ ID NO: 15502 - DNA, 315 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcatcgacgccaccactccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15503 - DNA, 345 bp, Artificial
  Mutation in BnaA.FAD2.a introduced by TALE nuclease pair BnFAD2_T02
cctctcctccctcaccctctcccttacctagcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaagtacattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15504 - DNA, 319 bp, Artificial
  Mutation in BnaA.FAD2.a introduced by TALE nuclease pair BnFAD2_T02
gctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttccaccattccaacactggctccctcgagagagacgaagtgtttgtccccaagaagaagtcagacatcaagtggtacggcaagtacctcaacacccctttgggacgcaccgtgatgttaacggttcagttcactctcggctggcctttgtacttag

SEQ ID NO: 15505 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgtgggacgcaccgtaatgttaacggttcagttcactctcggctggccttggtacgtaa

SEQ ID NO: 15506 - DNA, 356 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtccctcaacaaccctttgggacgcaccgtgatgttaacggttcagttcactctcggctggcctttgtacttag

SEQ ID NO: 15507 - DNA, 363 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtacacagtcatcgacgccaccattccaacactggctccctcgagagagacgaagtgtttgtcccaaagaagaagtcagacatcaagtggtacggcatgtacctcaacatccctttgggacgcaccgtgatgttaacggttcagttcactctcggctggcctttgtacttag

SEQ ID NO: 15508 - DNA, 344 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttcctcatcgacgccaccattccaacactggctccctcgagagagacgaagtgtttgtccccaagaagaagtcagacatcaagtggtacggcaagtacctcaacacccctttgggacgcaccgtgatgttaacggttcagttcactctcggctggcctttgtacctag

SEQ ID NO: 15509 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15510 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15511 - DNA, 356 bp, Artificial
  Mutation in BnaA.FAD2.a introduced by TALE nuclease pair BnFAD2_T02
cctctcctccctcaccctctcccttacctcgcctggcccctctactgggcatgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15512 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaaggcagacatcaagtggtacggcaagtacctcaacaaccctttgggacgcaccgggatgttatcggtgcagttcactcgcggctgccctgagtacttag

SEQ ID NO: 15513 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgtgggacgcaccgtgatgttaacggttcaggtcactctcggctggcctttgtacttag

SEQ ID NO: 15514 - DNA, 388 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtccattacttctcctggaggcctttttacggttcctggccttttgcgtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcatttgtacttag

SEQ ID NO: 15515 - DNA, 394 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacgccattgctggcgatggccaccacctgctggggggtcagtcatcgacgccaccattccaacactggctccctcgagagagacgaagtgtttgtccccaagaagaagtcagccatcaagtggtacggcaagtacctcaacaaccctttggaacgcaccgtgatgttaacggttcagttcactctcggctggcctttgtacttag

SEQ ID NO: 15516 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcgtcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15517 - DNA, 341 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15518 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgggaggttaacgttgcagttcactcgcgggtgccctgaatacttag

SEQ ID NO: 15519 - DNA, 347 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctccacgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15520 - DNA, 411 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcgtcttccactccttcctcctcgtcccttacttctcctggtggcaagcaggcgctggagacggtccagcggctgttgccggtgctgtgccaggcccagtcatcgacgccaccattccaacactggctccctcgagagggatgaagtgttcgtccccaagaagaaatccgacatcaagtggttcggaaagcacctcaaccgcccgctaggactcacggtgaggctaaccgcccacttcccgcccggctgccctttgtacttag

SEQ ID NO: 15521 - DNA, 315 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcatcgacgccaccattccaacactggctccctcgagagggatgaagtgttcgtccccaagaagaaatccgacatcaagtggtacggaaagtacctcaacaacccgctagtacgcaccgtgatgttaacgtttcagttctctcgcggctggcctttgtacttag

SEQ ID NO: 15522 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttggatcgcaccgggatgttaacggttcatgtcacttgcgggtgccctttgtacttag

SEQ ID NO: 15523 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctgtgggacgcaccgtgatgttaacggtgcaggtcactctcggctggcctttgtacttag

SEQ ID NO: 15524 - DNA, 352 bp, Artificial
  Mutation in BnaA.FAD2.a introduced by TALE nuclease pair BnFAD2_T02
cctcttccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15525 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagcagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 15526 - DNA, 357 bp, Artificial
  Mutation in BnaA.FAD2.a introduced by TALE nuclease pair BnFAD2_T02
cctctcctccctcaccctctctcctacttcgcctggcctctcttctgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15527 - DNA, 344 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgaccacgccttcagcgactaccagtggctggacgacaccgtcggcctcatcttccactccttcctcctcgtcccttacttctcccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15528 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtattag

SEQ ID NO: 15529 - DNA, 454 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacgatgttccagattacgctatcgatatcgccgatctacgcacgctcggctacagccagcagcaacaggagaagatcaaaccgaaggttcgttcgagtcatcgacgccaccattccaacactggctccctcgagagagacgaagtgtttgtccccaagaagaggtcagacatcaagtggtacggcaagtacctcaacaaccctttgggacgcaccgtgatgttaacggttcagttcactctcggctggcctttgtacttag

SEQ ID NO: 15530 - DNA, 323 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccgctcgccgcagccgaacgaccgagaagaagtcagacatcaagtggtacggaaagtacctcaacaaccctttgggacgcaccgtgatgttaacggttcagttcactctcggctggcctttgtacttag

SEQ ID NO: 15531 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15532 - DNA, 291 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 15533 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 15534 - DNA, 356 bp, Artificial
  Mutation in BnaA.FAD2.a introduced by TALE nuclease pair BnFAD2_T02
cctctcctccctcaccctctcccttacctcgcctggcacctctactgggcctgccaaggctgcgtcctaccgggcctctgggtcatcgcccacgaatgcggccaccacgccttcagcgactaccagtggctggacgacaccgtcggcctcatcttccactccttcctcctcgtcccttacttctcctggaaatcatcgacgccaccattccaacactggctccctcgagagagacgaattgtttgtccccaagaagaagtcagacatcaagtggtacggcaagtaccgcaacaaccgtttgggacgcaccgtgatgttaacggtgaaggtcactcgcgcgtgccctgagtacttag

SEQ ID NO: 15535 - DNA, 419 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacattccgtggcgttatccagctaagcgcgaactgcaatttggagaatggcagcgcaatgacacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15536 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggcctcatcttccactccttcctcctcgtcccttacttctcctggatcatcgacgccaccattccaacactggctccctcgagagagacgaagtgtttgtccccaagaagaagtcagacatcaagaggtacggcaagtacctcaacaaccctttgggacgcgccgtgatgttaacggttcaggtcactctcggctggcctttgtacttag

SEQ ID NO: 15537 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggcatcgacgccaccattccaacactggctccctcgagagagacgaagtgtttgtccccaagaagaagtcagacatcaagtggtacggcaagtacctcaacaaccctgttggacgcaccgtgatgttaacggttcagttcactctcggctggccttggtacttag

SEQ ID NO: 15538 - DNA, 355 bp, Artificial
  Mutation in BnaA.FAD2.a introduced by TALE nuclease pair BnFAD2_T02
cctctcctccatcaaccctctctcctacttcgcctggcctctctactgggcctgccagggctgcgtcctaaccggcgtctgggtcatagcccacgagtgcggccaccacgccttcagcgactaccagtggcttgacgacaccgtcggtctcgtcttccactccttcctcctcgtcccttacttctcctggaagatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgccctttgtacttag

SEQ ID NO: 15539 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 15540 - DNA, 389 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaagtatggtggccatcgccagcaatggcggtgacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggccttagtacttag

SEQ ID NO: 15541 - DNA, 358 bp, Artificial
  Mutation in BnaA.FAD2.a introduced by TALE nuclease pair BnFAD2_T02
cctctcctccctcaccctctctcctacttcgcctggcctctctactgggcccgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaacccgctaggacgcacggtgatgctaaccgtccatgtcacgctcggctgccctttgtacttag

SEQ ID NO: 15542 - DNA, 360 bp, Artificial
  Mutation in BnaA.FAD2.a introduced by TALE nuclease pair BnFAD2_T02
cctctcctccatcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagtaagtcatcgacgccaccattccaacactggctccctcgagagagacgaagtgtttgtccccaagaagaagtcagacatcaagtggtacgggaagtacctcaacaaccctttgggacgaaccgtgatgttaacggttcagttcactctcggctggcctttgtacttag

SEQ ID NO: 15543 - DNA, 360 bp, Artificial
  Mutation in BnaA.FAD2.a introduced by TALE nuclease pair BnFAD2_T02
cctctcctccatcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagtaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15544 - DNA, 350 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctcatcgacgccaccattccaacactggctccctcgagagagacgaagtgtttgtccccaagaagaagtcagacatcaagtggtacggcaagtacctcaacaaccctttggaacgctccgtgatgttaacggttcagttcactctcggctggcctttgtacttag

SEQ ID NO: 15545 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccttgtcatcgacgccaccattccaacactggctccctcgagagagacgaagtgtttgtccccaagaagaaatccgacatcaagtggtacggaaagtacctcaacaaccctctaggacgcactgttatgctaaccgtccaggtcacgctcggctggcctttgtacttagc

SEQ ID NO: 15546 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctcagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 15547 - DNA, 344 bp, Artificial
  Mutation in BnaA.FAD2.a introduced by TALE nuclease pair BnFAD2_T02
cctctcctccctcaccctctatcctacttcgcctggcccctctactgcgcctgccaaggctgcgtcctaacgggcctctgggtcatcgcccacgaatgcggccaccacgccttcagcgaccaccagtggctggacgacgccgtgggcctcgtcttccactccttcctcctcgtcccttactcatcgacgccaccattccaacactggctccctcgagagagacgaagtgtttgtccccaagaagaagtcagacatcaagtggtacggcaagtaccgcaacaaccctttgggacgcaccgttatgttaacggttcatttctctctcggctggcctttgtacttag

SEQ ID NO: 15548 - DNA, 348 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttcttcatcgacgccaccattccaacactggctccctcgagagagacgaagtgtttgtccccaagaagaagtcagacatcaagtggtacggcaattacctcaacaaccctttgggacgcaccgggatgttaacggttcagttctctctcggctggcctttgtacttag

SEQ ID NO: 15549 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctgcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15550 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15551 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctacctcgagagagacgaagtgtttgtccccaagaagaagtcagacatcaagtggtacggcaagtacctcaacaaccctttgggacgcaccgtgatgttaacggttcagttcgctctcggctgccctttgtacttag

SEQ ID NO: 15552 - DNA, 347 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccacgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctgccctttgtacttag

SEQ ID NO: 15553 - DNA, 366 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacaatcagaaaaggtccactgggttcgtgccttccaccattccaacactggctccctcgagagagacgaagtgtttgtccccaagaagaaatccgacatcaagtggtacggaaagtacctcaacaacccgctaggacgcacggtgatgctaaccggccagttcacgctcggctggcctttgtacttag

SEQ ID NO: 15554 - DNA, 324 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15555 - DNA, 332 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaactggctccctcgagagagacgaagtgtttgtccccaagaagaagtcagacatcaagtggtacggcaagtacctcaacaaccctttgggacgcaccgtgatgttaacgggtcagttcactctcggctggcctttgtacttag

SEQ ID NO: 15556 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcccatcgacgccaccattccaacactggctccctcgagagagacgaagtgtttgtccccaagaagaagtcagacatcaagtcgtacggcaactacctcaacatccctttgggacgcgacgtgatgttaacggttcagttcactctcggctgccatgtgtacttag

SEQ ID NO: 15557 - DNA, 318 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggagagagacgaagtgtttgtccccaagaagaagtcagacatcaagtggtacggcaagtacctcaacaaccgtttgggacgcaccgggatgttaacgtgtcagttctctctcggctggcctttgtacttag

SEQ ID NO: 15558 - DNA, 312 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttaacgacaccgtcggtctcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 15559 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctagccatcgacgccaccattccaacaccggatccctcgagagagacgaagtgtttgtccccaagaagaagtcagacatcaagtggtacggcaagtacctcaacaaccctgtgggacgcaccgggaggttaacggtgcaggtcactctcggctggccttcgtacttag

SEQ ID NO: 15560 - DNA, 357 bp, Artificial
  Mutation in BnaA.FAD2.a introduced by TALE nuclease pair BnFAD2_T02
cctctcctccctcaccctctctcctacttcgcctgacatctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagttcctcaacaaccctggggcgcgcgccgtgatggtaacggttcagttcactctcggctgaccttagtgcttag

SEQ ID NO: 15561 - DNA, 408 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccggtgctgtgccaggcccacggcttgaccccccagcaggtggtggccagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggttggcctttgtacttag

SEQ ID NO: 15562 - DNA, 356 bp, Artificial
  Mutation in BnaA.FAD2.a introduced by TALE nuclease pair BnFAD2_T02
cctctcctacctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 15563 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcttcgacgccaccattccaacactggctccctcgagagagacgaagtgtttgtccccaagaagaagtcagacatcaagtggtacggcaagtacctcaacaacccttggggacgcaccgtgatgttaacggttcaggtcactctcggctggcctttgtacttag

SEQ ID NO: 15564 - DNA, 358 bp, Artificial
  Mutation in BnaA.FAD2.a introduced by TALE nuclease pair BnFAD2_T02
cctctcctccctcaccctctcccttacctcgcctggcctctctactggccctgccaagggtgcgtcttacccgccgtctggttcatagcccacgaatgcgccccccccgccttcagcgaccaccagtggctggccgacgccgtgggcctcgtcttccactccttcctcctcgccccttacttctcctgaaacagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctgtgtacttag

SEQ ID NO: 15565 - DNA, 344 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttactcatcgacgccaccattccaacactggctccctcgagagggatgaagtgttcgtccccaagaagaaatccgacatcaagtggtacggaaagtacctcaacaacccgctaggacgcacggtgatgctaaccggccagttcacgctcggctggcctttgtacttag

SEQ ID NO: 15566 - DNA, 348 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttcttcatcgacgccaccattccaacactggctccctcgagagggatgaagtgttcgtccccaagaagaaatccgacatcaagtggtacggcaagtacctcaacaaccctttgggacgcaccgtgatgttaacggttcagttcactctaggctggcctttgtacttag

SEQ ID NO: 15567 - DNA, 357 bp, Artificial
  Mutation in BnaA.FAD2.a introduced by TALE nuclease pair BnFAD2_T02
cctctcctccctcaccctctcccttacctcgcctggcccctctactgcgcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgaggttaacgggtcagttctctctcggctggcctttgtacttag

SEQ ID NO: 15568 - DNA, 356 bp, Artificial
  Mutation in BnaA.FAD2.a introduced by TALE nuclease pair BnFAD2_T02
cctctcctccctcaccctctctcctacttcgcctggcctctctactggacctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15569 - DNA, 350 bp, Artificial
  Mutation in BnaA.FAD2.a introduced by TALE nuclease pair BnFAD2_T02
cctctcctccctcaccctctctcctacttcgcctggcatatataatgagcctgccaagggtgcgtcctaacaggcgtctgggtcatagcccacgagtgcggccaccacgccttcagcgactaccaggggctggacgacaccgtcggcctcatcttccactccttcctcctcgtcccttacttctagtcatcgacgccaccattccaacactggctccctcgagagagacgaagtgtttgtccccaagaagaagtcagacatcaagtggtacggcaaggacctcaacaaccctctgggacgcaccgtgatgttaccggttcatgtcacttgcgcctgcccttagtacgtag

SEQ ID NO: 15570 - DNA, 350 bp, Artificial
  Mutation in BnaA.FAD2.a introduced by TALE nuclease pair BnFAD2_T02
cctctcctccctcaccctctctcctacttcgcctggcatctctactgggcctgccaagggtgcgtcctaaccggcgtctgggtaatagcccacgagtgcggccaccacgccttcagcgactaccagtggctggacgacaccgtcggcctcatcttccactccttcctcctcgtcccttacttctagtcatcgacgccaccattccaacactggctccctcgagagagacgaagtgtttgtccccaagaagaagtcagacatcaagtggtacggcaagtacctcaacaaccctttgggacgcaccgtgatgttaacgtttcagttcactctcggctggcctttgtacttag

SEQ ID NO: 15571 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacatccctttgggccgcaccgtgatgttaacggttcaattcactcccggctgccctttgtacttag

SEQ ID NO: 15572 - DNA, 356 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacgacccttggggacgcaccgtgatgttaacggttcagttcactctcggcgggcctttgtacttag

SEQ ID NO: 15573 - DNA, 345 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttcatcgacgccaccattccaacactggctccctcgagagagacgaagtgtttgtccccaagaagaagtcagacatcaagtggtacggcaagtacctcaacaaccctttgggacgcaccgtgatgttaacgggtcagttcactctcggctggcctttgtacttag

SEQ ID NO: 15574 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 15575 - DNA, 345 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctattccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 15576 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 15577 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcccggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15578 - DNA, 332 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtggctccctcgagagagacgaagtgtttgtccccaagaagaagtcagacatcaagtggtacggcaagtaccacaacaaccctttgggacgcaccgtgatgttaacggttcagttcactctcggctggcctttgtacttag

SEQ ID NO: 15579 - DNA, 365 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaacagtggctggacgacaccgtcggcctcatcttccactccttcctcctcgtcccttacttctcctggaagtacaaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15580 - DNA, 394 bp, Artificial
  Mutation in BnaA.FAD2.a introduced by TALE nuclease pair BnFAD2_T02
cctctcctccctcaccctctctcctacttcgcctggcctctctactgggcctgccggggctgcgtcctaaccggcgtctgggtcatcgcccacgagtgcggccaccacgccttcagcgactaccagtggctggacgacaccgtcggcctcatcttccactccttcctcctcgtcccttacttctcctggaagtattgagtgagctgataccgctcgccgcagccgaacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 15581 - DNA, 394 bp, Artificial
  Mutation in BnaA.FAD2.a introduced by TALE nuclease pair BnFAD2_T02
cctctcctccctcaccctctctcctacttcgcctggcctctctactgggcctgccggggctgcgtcctaaccggcgtctgggtcatagcccacgagtgcggccaccacgccttcagcgactaccagtggctggacgacaccgtcggcctcatcttccactccttcctcctcgtcccttacttctcctggaagtattgagtgagctgataccgctcgccgcagccgaacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 15582 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaacaaatcatcgacgccaccattccaacactggctccctcgagagagacgaagtgtttgtccccaagaagaagtcacacatcaagtggtacggcaagcacctcagcatccctcctggccgcaccgtgaggtttacggctcagttcactctcgcatgcctttagtaattag

SEQ ID NO: 15583 - DNA, 341 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaattccaacactggctccctcgagagagacgaagtgtttgtccccaagaagaagtcagacatcaagtggtacggcaagtacctcaacaacccgctaggacgcacggtgatgctaaccgtccagttcacgctcggctgccctttgtacttag

SEQ ID NO: 15584 - DNA, 356 bp, Artificial
  Mutation in BnaA.FAD2.a introduced by TALE nuclease pair BnFAD2_T02
cctatcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaattcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtgcttag

SEQ ID NO: 15585 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctcccgcgagagagacgaagtgtgtgtccccaagaagaagtcagacatcaagtggtacggcaagtacctcaacaaccctttgggacgcaccgtgatgttaacggttcagttcactctcggctggcctttgtacttag

SEQ ID NO: 15586 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgctaggacgcgcggtgatgctaaacgtccagttcacgctcggctggcctttgtacttag

SEQ ID NO: 15587 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttccctctcggctggcctttgtacttag

SEQ ID NO: 15588 - DNA, 345 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgccaccgtcggtctcatcttccactccttcctcctcgtcccttacttctcctggaagtacattccaacactgtctccctcgagagagacgaagtgtttgtccccaataagaagtcagacatcaagtggtacggcaagtacctcaacaaccctttgggacgcaccgtgaggttaacggttcagttcactctcggctggccttagtacttag

SEQ ID NO: 15589 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtgggcctcgtcttccactccttcctcctcgtcccttacttctccttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15590 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgtgaacggttcagttcactctcggctggcctttgtacttag

SEQ ID NO: 15591 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcctagcccacgagtgcggccaccacgccttcagcgactaccagtggctggacgacaccgtcggcctcatcttccactccttcctcctcgtcccttacttctcctggaatcgacgccaccattccaacactggctccctcgagagagacgaagtgtttgtccccaagaagaagtcagacaccaggtggtacggcaagtacctcaacgaccgtgtgggacgcgccgggaggttaaggttgcagttccctttcggctgcccttgctactgag

SEQ ID NO: 15592 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacaccggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15593 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgccctttgtacttag

SEQ ID NO: 15594 - DNA, 324 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccatcgacgccaccattccaacactggctccctcgagagagacgaagtgtttgtccccaagaagaagtcagacatcaagtggtacggcaagtacctcaacaaccctgtgggacgcgtcgtgaggttatcggttcagttctctctcggctggccttggtacttag

SEQ ID NO: 15595 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaccacccctgtgggacgcaccgtgatgttaacggttcagttcactctcggctggcctttgtacttag

SEQ ID NO: 15596 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgcgccctaaccggcgtctgggtcatagcccacgagtgcggccaccacgccttcagcgactaccagtggctggacgacaccgtcggcctcatcttccactccttcctcctcgtcccttacttctcctggaagtatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15597 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcatgtcactcgcggctggcctttgtacttag

SEQ ID NO: 15598 - DNA, 359 bp, Artificial
  Mutation in BnaA.FAD2.a introduced by TALE nuclease pair BnFAD2_T02
cctctcctccctcaccctctctcctacttcgcctggcctctctactgggcctgacaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtaccgcaacaaccctttgggacgcaccgtgatgttaacgattcaggtctctctcggctggcctttgtacttag

SEQ ID NO: 15599 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaacagtcatcgacgccaccattccaacactggctccctcgagagagacgaagtgtttgtccccaagaagaagtcagacatcaagtggtccggctattacctcaacagcccttggggacgcacggtgatgctagccggccagttcacgcttggctgccctttgtacttag

SEQ ID NO: 15600 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctcaccggcgtctgggtcatagcccacgagtgcggccaccacgccttcagcgactaccagtggcttgacgacaccgtcgttctcatcttccactccttcctcctcgtccctttcttctcctggaaacagtcatcgacgccaccattccaacactggctccctcgagagagacgaagtgtttgtccccaagaagaagtcagacatcaactggtacgtcaagtacctcaacaaccctcctggccgcacggtgatgctaaccgtccagttcacgctcgcctgccctttgtacttag

SEQ ID NO: 15601 - DNA, 413 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacaatggccaccacctgctggggggtcaagccgtgggcctggcacagcaccggcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15602 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggccttggtacttag

SEQ ID NO: 15603 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagatcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 15604 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15605 - DNA, 467 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagggaccgtctccagcgcctgcttgccaccattattgctggcgatggccaccacctgctggggggtcaagccgtgggcctggcacagcaccggcaacagccgctggaccgtctccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15606 - DNA, 347 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcatcgacgccaccaatccaacaccggatccctcgagagggatgaagtgttcgtccccaagaagaagtcagacatcaagtggtacggcaagtacctcaacaaccctttgggacgcaccgtgatgttaacggtgcagttcactctcggctgccctttgtacttag

SEQ ID NO: 15607 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccatgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15608 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttgactctcggctggcctttgtacttag

SEQ ID NO: 15609 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggcctttgtacttag

SEQ ID NO: 15610 - DNA, 379 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtccattacttctcctggctccgcccccctgacgagcatcacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15611 - DNA, 324 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccatcgacgccaccattccaacactgactccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 15612 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcatttctctctcggctggcctttgtacttag

SEQ ID NO: 15613 - DNA, 291 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 15614 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgcgcggctggcctgtgtacttag

SEQ ID NO: 15615 - DNA, 357 bp, Artificial
  Mutation in BnaA.FAD2.a introduced by TALE nuclease pair BnFAD2_T02
cctctcctccctcaccctctctcctacttcgcctggcctctctcctgggcctgccaagggtgcgtcccaaccggcgtctgggtcacagcccacgagtgaggccaccacgccttcagcgactaccagtggctggacgacaccgtcgccctcatcttccactccttcctcctcgtcccttacttctcctggaaagtcatcgacgccaccattccaacactggctccctcgagagagacgaagtgtttgtccccaagaagaaggcagacatcaagtggtacggcaagtacctcagcatcccttttggacgcaccttgatgttaacggttcagttcactcccggctgccctttgtgcttag

SEQ ID NO: 15616 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 15617 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggccttagtacttag

SEQ ID NO: 15618 - DNA, 359 bp, Artificial
  Mutation in BnaA.FAD2.a introduced by TALE nuclease pair BnFAD2_T02
cctctcctccctcaccctctctcctacttttcctggcccctctactgtgattgccaaggctgcgtcctaacgggcctctgggtcatcgcccacgaatgcgtccacgacgccttcagcgaccaccagtggctggacgacgccgtgggcctcgtcttccactccttcctcctcgtcccttacttctcctggaagtagtcatcgacgccaccattccaacactggctccctcgagagagacgaagtgtttgtccccaagaagaagtcagacatcaagtggtacggcaagtacctcaccaccccatagggacgcaccgtgatgttaccggttcatgtccctctcggctggcctttgtacttag

SEQ ID NO: 15619 - DNA, 356 bp, Artificial
  Mutation in BnaA.FAD2.a introduced by TALE nuclease pair BnFAD2_T02
cctctcctccctcaccctctctcctacttcgcctggcctctctactgcgcctgccaaggctgcgtcctaaccgacgtctgggtcatagcccacgagtgcggccaccacgccttcagcgactaccagtggctggacgacaccgtcggcatcatcttccactccttcctcctcgtcccttacttctcctggaagtcatcgacgccaccattccaacactggctcccgccagagagacgaagtgtttgtccccaagaagaaatcagacatcaagtggtacggcaactaccacaacaacccttatggacgcgccgtgatgttaacggcacagatcagtctcggctggcctaggtacttag

SEQ ID NO: 15620 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacgacgccaccattccaacactggctccctcgagagagacgaagtgtttgtccccaagaagaagtcagacatcaagtggtacggcaagtacctcaacaaccctgtgggacgcaccgtgatgttaacggtgcagttcactatcggctggcctttgtacttag

SEQ ID NO: 15621 - DNA, 354 bp, Artificial
  Mutation in BnaA.FAD2.a introduced by TALE nuclease pair BnFAD2_T02
cctctcctccctcaccctctaccttacctcggctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtaccgcaacaacccttgtggacgcaccgtgatgttaacgggtcaggtctctctcgtctggcctttgtgcttag

SEQ ID NO: 15622 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15623 - DNA, 356 bp, Artificial
  Mutation in BnaA.FAD2.a introduced by TALE nuclease pair BnFAD2_T02
cctctcctcctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctaggctggcctttgtacttag

SEQ ID NO: 15624 - DNA, 359 bp, Artificial
  Mutation in BnaA.FAD2.a introduced by TALE nuclease pair BnFAD2_T02
cctctcctccctcaccctctctcctacttcgcctggcctctctcctgggcctgccagggctgcgtcctaaccggcgtctgggtcatagcccacgagtgcggccaccacgccttcagcgactaccagtggctggacgacaccgtcggccacatcttccactccttcctcctcctcccttacttctcctggaagcagtcatcgacgccaccattccaacactggctccctcgagagagacgaagtgtttgtccccaagaagaagtcagacatcaagtggtacggcaagtacctcaacaaccctctgggacgcaccgtgatgttaacggttcaggtcactctcggctggcctcagtgcttag

SEQ ID NO: 15625 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcatttgtacttag

SEQ ID NO: 15626 - DNA, 312 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15627 - DNA, 340 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcagtcatcgacgccaccattccaacactggctccctcgagagagacgaagtgtttgtccccaagaagaagtcagacatcaagtggtacggcaagtacctcaacaaccctttgggacgcaccgtgatgttaacgggtcagttcactctcggctggcctttgtacttag

SEQ ID NO: 15628 - DNA, 291 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtcttggtcatagcccacgagtgcggccaccacgccttcagcgactaccagtggcttgactacaccgtcggaagactggctccctcgagagagacgaagtgtttgtccccaagaagaagtcagacatcaagtggtacggcaagtacctcaacaaccctttgggacgcaccgtgatgttaacggttcagttcactctcggctggccttggtacttag

SEQ ID NO: 15629 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgtgggacgcaccgtgaggttaacggttcaggtcactcccggctggccttggtacttag

SEQ ID NO: 15630 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtaccgcaacaaccctttgggacgcaccgtgatgttaacggttcaggtcactcccgcctggcctttgtgcttag

SEQ ID NO: 15631 - DNA, 355 bp, Artificial
  Mutation in BnaA.FAD2.a introduced by TALE nuclease pair BnFAD2_T02
cctctcctccctcaccctctcccttacctcgcctgtcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaacatcgacgccaccattccaacactggctccctcgagagagacgaagtgtttgtccccaagaagaagtcagacatcaagtggtacggcaagtacctcaacaaccctgtgggacgcaccggaatgttatcggttcagttcactcccggctgccctttgtacttag

SEQ ID NO: 15632 - DNA, 423 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagttaggccaccacttcaagaactctgtagcaccgcctacatacctcgctctgctaatcctgttagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15633 - DNA, 357 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacactggctccctcgagagagacgaagtgtttgtccccaagaagaagtcagacatcaagtggtacggcaagtacctcaacaaccctggggtacgcaccgtaatgttaacggttcagttcactctcggctggcctttgtacttag

SEQ ID NO: 15634 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtaagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 15635 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggcaagtacctcaacaacccttggggacgcaccgtgatgttaacggttcagttcactctcggctggcctgtgtacttag

SEQ ID NO: 15636 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacaacggcgagctttgatcaacgaccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15637 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtaccgcaacaaccctttgggacgcaccgtgatgctatcgggtcatttctctcgcgcgcgccctgtgtacttag

SEQ ID NO: 15638 - DNA, 356 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaaggggcctctgggtcatcgcccacgaatgcggccaccacgccttcagcgaccaccagtggctggacgacgccgtgggcctcgtcttccactccttcctcctcgtcccttacttctcctggaattcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15639 - DNA, 346 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgaatgcggccaccacgccttcagcgaccaccagtggctggacgacgccgtgggcctcgtcttccactccttcctcctcgtcccttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15640 - DNA, 349 bp, Artificial
  Mutation in BnaA.FAD2.a introduced by TALE nuclease pair BnFAD2_T02
cctctcctccctcaccctctctccaacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttccgtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 15641 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 15642 - DNA, 367 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacacacacagtcatcgacgccaccattccaacactggctccctcgagagagacgaagtgtttgtccccaagaagaagacagacatcaagtggtacggcaagtacctcaacaaccctttgggacgcaccgtgatgttaacggttcagttcactctcggctggcctttgtacttag

SEQ ID NO: 15643 - DNA, 357 bp, Artificial
  Mutation in BnaA.FAD2.a introduced by TALE nuclease pair BnFAD2_T02
cctctcctccctcaccctctctcctacttcgccttgcctctctactgggcctgccagggctgcgtcctaaccgacgtctgggtcctagcccacgagtgctgccaccacaccttccgcgactaccagtggctggacgacaccgtcggcctcatcttccactccttcctcctcgtcccttacttctcctggaagttcatcgacgccaccattccaacactggctccctcgagagagacgaagtgtttggccccaagaagaagtcagacatcaagtggtacggcaagtacctcaacaatcctttgggacgcagcgtgatgttaacgtttcagttcactctcggctgccatgtgtacttag

SEQ ID NO: 15644 - DNA, 272 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggccttttacttag

SEQ ID NO: 15645 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctctcagccatcgacgccaccattccaacaccggatccctcgagagggatgaagtgttcgtccccaagaagaaatcagacatcaagtggtccggcaagtcccccaccacccctttgggacgcaccgtgatgttaacgcttcagctccctctcggctggcctttgtacttag

SEQ ID NO: 15646 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcatttcactctcggctggcctgtgtacttag

SEQ ID NO: 15647 - DNA, 357 bp, Artificial
  Mutation in BnaA.FAD2.a introduced by TALE nuclease pair BnFAD2_T02
cctctcctccctcaacctctctcctacttcgcctggcctctttactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaattcagacaacaagtggtacggcaagtgcctcaacaaccctctggggcgcaccgtaatgttaacggttcatttcattcgcgggtgccctttgtacttag

SEQ ID NO: 15648 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtgactggacgacaccgtcggcctcatcttccactccttcctcctcgtcccttacttctcctggaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15649 - DNA, 454 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctgacggtccagcggctgttgccggtgctgtgccaggcccacggcttgaccccccagcaggtggtggccatcgccagcaatggcggtggcaagcaggcgctggagtcatcgacgccaccattccaacactggctccctcgagagagacgaagtgtttgtccccaagaagaagtcagacatcaagtggtacggcaagtacctcaacaaccctgtgggacgcaccgggatgttaacggttcagttcactctcggctggcctttgtacttag

SEQ ID NO: 15650 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagcatcgacgccaccattccaacactggctccctcgagagagacgaagtgtttgtccccaagaagaaggcagacatcaagtggtacggcaagtacctcaacaaccctttgggacgcaccgtgatgttaacggttcagttcactctcggctggcctttgtacttag

SEQ ID NO: 15651 - DNA, 318 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagagagacgaagtgtttgtccccaagaagaagtcagacatcaagtggtacggcaagtacctcaacaaccgtttgggacgccccgtgatgttaacggttcagttcactctcgcctggcctgtgtacttag

SEQ ID NO: 15652 - DNA, 363 bp, Artificial
  Mutation in BnaA.FAD2.a introduced by TALE nuclease pair BnFAD2_T02
cctctcctccctcaccctctcacttacctcgcctggcccccctactgggcctgccaaggctgcgtcctaccgggcctctgggtcatcgcccacgaatgcggccaccacgccttcagcgaccaccagtggctggacgacgccgtgggcctcgtcttccactccttcctcctcgtcccttacttctcctggaagtacacagtcatcgacgccaccattccaacactggctccctcgagagagacgaagtgtttgtccccaagaagaagtcagacatcaagtggtacggcaaggacctcaacaaccctttgggacgcaccgtgatgttaacgttgcagttcacttgcgcctggcctttgtacttag

SEQ ID NO: 15653 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaagttacagtcatcgacgccaccattccaacaccggatccctcgagagggatgaagtgttcgtccccaagaagaagtcagacatcaagtggtacggcaagtacctcaacaaccctttgggacgcaccgggatgttaacggttcagttcactctcggctggcctttgtacttag

SEQ ID NO: 15654 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctgggcgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaaggacctcaacaaccctttgggacgcgccgtgatgttaacggtgcatgtcactctcgtctgtcctttatacttag

SEQ ID NO: 15655 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgcccccattccaacactggctccctcgagagagacgaagtgtttgtccccaagaagaaggcagacatcaagtggtacggcaagtacctcaacaacccttggggacgcaccgtgatgttaacgggtcaggtcactctcggctggcctttgtacttag

SEQ ID NO: 15656 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcgcgctcggctggcctttgtacttag

SEQ ID NO: 15657 - DNA, 482 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcatctgggtcatagcccacgagtgcggccaccacgccttcagcgactaccagtggctggacgacaccgtcggcctcatcttccactccttcctcctcgtcccttacttctcctggaagtggcacagcaccggcaacagccgctggaccggctccagcgcctgcttgctgatagtgaccttaggcgacctttgaacgcgcactaatgggggtcaagccgtgggcctggcacagcaccggcaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15658 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctgggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15659 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctccagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15660 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15661 - DNA, 359 bp, Artificial
  Mutation in BnaA.FAD2.a introduced by TALE nuclease pair BnFAD2_T02
cctctcctccctcaccctctctcctacttcgcctggcctctctattgagcctgccagggctgcgtcctaaccggcgtctgggtcatagcccacgagtgcggccaccacgccttcagcgactaccagtggctagacgacaccgtcggcctcatcttccactccttcctcctcgtcccttacttctcctggaagttgtcatcgacgccaccattccaacaccggatccctcgagagggatgaagtgttcgtccccaagaagaagtcacacatcaagtggtacggcaagtacctcaacaaccctttgggacgcaccgtgaggttaacggttcaggtcactctcgcctgccctttgtgcttag

SEQ ID NO: 15662 - DNA, 409 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaccttgaccgaacgcagcggtggtaacggcgcagtggcggttttcatggcttgagtcatcgacgccaccattccaacactggctccctcgagagagacgaagtgtttgtccccaagaagaggtcagacatcaagtggtacggcaagtacctcaacaaccctgtgggacgcaccgtgatgttaacggttcagttcactctcggctggcctttgtacttag

SEQ ID NO: 15663 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15664 - DNA, 360 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15665 - DNA, 352 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggcatcgacgccaccattccaacactggctccctcgagagagacgaagtgtttgtccccaagaagaagtcagacatcaagtggtacggcaagtacctcaacaaccctgtgggacgcaccgtgatgttaacggttcaggtcactctcggctggcctttgtacttag

SEQ ID NO: 15666 - DNA, 353 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggtcatcgacgccaccattccaacaccggatccctcgagagagacgaagtgtttgtccccaagaagaagtcagacatcaagtggtacggcaagtacctcaacaaccctttgggacgcaccgggatgttaaccgtccaggtcacgctcggctggcctttgtacttag

SEQ ID NO: 15667 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15668 - DNA, 412 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaagtcggtggacctctcaactctcccgccaccgtgagcaaggcctccagagcgcgtgcgtcatcgacgccaccattccaacactggctccctcgagagagacgaagtgtttgtccccaagaagaagtcagacatcaagtggtacggcaagtacctcaacgaccctgtgggacgcgccgggagggtaacggggccgttcactcccggctgccctttgtccttag

SEQ ID NO: 15669 - DNA, 388 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaggcctttttacggttcctggccttttgcgtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15670 - DNA, 356 bp, Artificial
  Mutation in BnaA.FAD2.a introduced by TALE nuclease pair BnFAD2_T02
cctctcctcctcaccctctctcctacttcgcctggcctctctactgggcctgccaagggtgcgtcctaaccgtcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15671 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttctcctggatcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 15672 - DNA, 356 bp, Artificial
  Mutation in BnaA.FAD2.a introduced by TALE nuclease pair BnFAD2_T02
cctctcctccctcaccctctctcctacttcgcctggcatctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtccctcaacacccatttggatcgcacagtgctgttaacccttcagttccctctcggctggcctttgtacttag

SEQ ID NO: 15673 - DNA, 384 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccacgatggcggcaagcaggcgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15674 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15675 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 15676 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgtggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 15677 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggccccatcttccactccttcctcctcgtcccttacttctcctggacatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 15678 - DNA, 291 bp, Artificial
  Mutation in BnaA.FAD2.a introduced by TALE nuclease pair BnFAD2_T02
cctctcctccctcaccctctcccttacctcgcctggcccctctactgggcatgccaaggctgcgtcctaacgggcctctgggtcatcgcccacgaatgaggccaccacgccttcagcgactaccagtggctggacgacaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 15679 - DNA, 353 bp, Artificial
  Mutation in BnaA.FAD2.a introduced by TALE nuclease pair BnFAD2_T02
cctctcctccctcaccctctctcctacttcgcctggcctccctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacatcgacgccaccattccaacaccggatccctcgagagagacgaagtgtttgttcccaagaagaagtcagacatcaagtggtacggcaagtacctcaacaaccctttgggacgcaccgtgatgttaacggttcagttcactctcggctggcctttgtacttag

SEQ ID NO: 15680 - DNA, 397 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatgcccgaggcatagactgtaccccaaaaaaacagtcataagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15681 - DNA, 310 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccaccattccaacactggctccctcgagagagatgaagtgttcgtccccaagaagaaatccgacatcaagtggtacggaaagtacctcaacaaacctgtgggacgcgccgtgagtttaacggttcagttcactctcggctgacctgtgtacttag

SEQ ID NO: 15682 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15683 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcatttcactctcggctggcctttgtacttag

SEQ ID NO: 15684 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcatttcactctcggctggcctttgtacttag

SEQ ID NO: 15685 - DNA, 356 bp, Artificial
  Mutation in BnaA.FAD2.a introduced by TALE nuclease pair BnFAD2_T02
cctctcctccctcaccctctctcctacttcgcctggcctctctaatgggcctgccagggctgcgtcctaaccggcgtctgggtcatagtccacgagtgcggccaccacacctacagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcttccctttgtccttag

SEQ ID NO: 15686 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgtgggacgcaccgggatgttaacggttcagttcactctcggctggcctttgtacttag

SEQ ID NO: 15687 - DNA, 336 bp, Artificial
  Mutation in BnaA.FAD2.a introduced by TALE nuclease pair BnFAD2_T02
cctctcctccctcaccctctcccttacctcgcctgacccctctactgagcctgccagggctgcgtcctcaccggcgtctgggtcatagcccacgagtgcggccaccacgccttcagcgactaccagtggcttcacgacaccgtcggtctcatcttccactccttccccctcgtcatcgacgccaccattccaacactggctccctcgagagagacgaagtgtttgtccccaagaagaagccagacatcaagtggtacggcaagtacctcaacaacccgctaggacgcagggtgaggctaagcgtccaggtctggctcgcctggcctttgtgcttag

SEQ ID NO: 15688 - DNA, 354 bp, Artificial
  Mutation in BnaA.FAD2.a introduced by TALE nuclease pair BnFAD2_T02
cctctcctccctcaccctctcccttacctcgcctggtccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 15689 - DNA, 354 bp, Artificial
  Mutation in BnaA.FAD2.a introduced by TALE nuclease pair BnFAD2_T02
cctctcctccctcaccctctcccttacctcgcctggtccctctactgggcctgccaaggctgcgtcctaacgggcctctgggtcatcgcccacgaatgcggccaccacgccttcagcgaccaccagtggctggacgccgccgttggcctcgtcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcatttcactctcggctggcctttgtacttag

SEQ ID NO: 15690 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagcggtacggcaagtacctcaacacccctttgggacgcaccgtgatgttaacggttcagttccctctcggctcgcgtttgccctta

SEQ ID NO: 15691 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 15692 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15693 - DNA, 344 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttcctcatcgacgccaccattccaacactggctccctcgagagagacgaagtgtttgtccccaagaagaagtcacacatcaagtggtacggcaagtacctcaacaaccctttgggacgcaccgtgatgttaacggttcagttcactctcggctggcctttgtacttag

SEQ ID NO: 15694 - DNA, 356 bp, Artificial
  Mutation in BnaA.FAD2.a introduced by TALE nuclease pair BnFAD2_T02
cctctcctccctcaccctctctcctacttcgcctgtcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaataagaagccacacctcaagtcgtacggcaagcaccccaacaagcgttctggacgccccctgagtcttacgcctcaggtcccgctcgactgcccttagtgcttag

SEQ ID NO: 15695 - DNA, 311 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcgtctttgtccccaagaagaagtcagacatcaagtggtacggcaagtacctcaacaaccctttgggacgcaccgtgatgttaacggttcagttccctctcggctggcctttgtacttag

SEQ ID NO: 15696 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 15697 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaagccatcgacgccaccattccaacaccggatccctcgagagggatgaagggttcgtccccaagaagaagtcagacatcaagtggtacggcaagtacctcaacaaccctttgggacgcaccgtgatgttaacggttcagttcactctcggctggccttggtacttag

SEQ ID NO: 15698 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgccctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtaccccaacgcccctgtgggacgcaccatgaggttaacggttccgttcactctcggctggcctttgtacttag

SEQ ID NO: 15699 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15700 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgcccgccagtggctggacgacgccgtgagcctcgtcttccactccttcctcctcgtcccttacttctcctggaagtcatcgccgccaccattccaacactggctccctcgagagagacggagtgtttgtccccaataagaagtcagacatcaagtggtacggcaagtacctcaacaacccgtggggacgcaccgtgaggtgaacggttcagttcactctcggctggcctttgtacgtag

SEQ ID NO: 15701 - DNA, 417 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacgtctccagcggctgttgccggtgctgtgccaggcccacggcttgaccccggagcaggtggtggccatcgccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15702 - DNA, 414 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgaccacgaatgcggccaccacgccttcagcgaccaccagtggctggacgacgccgtgggcctcgtcttccactccttcctcctcgtcccttacttctcctggagaccccccagcagggggtggccatcgccagcaataatggtggaaagcaggcgcgggagagtcatcgacgccaccaggccaacacgggctccctcgagagagacgaagtgttggtccccaagaagaagtcagacatcaagtggtacggcaagtacctcaacaaccctgggggacgcaccgtgatgttaacggttcagatcactctcggctgccctttgtacgtag

SEQ ID NO: 15703 - DNA, 389 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaagtatggtggccatcgccagcaatggcggtgacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15704 - DNA, 345 bp, Artificial
  Mutation in BnaA.FAD2.a introduced by TALE nuclease pair BnFAD2_T02
cctctcctccctcaccctctctcctacttagcctggcctctctactgggcctgccagggctgcgtcctaaccggcgtctgggtcatagcccacgagtgcggccaccacgccttcagcgactacaagtggcttgacgacaccgtcggtctcatcttccactccttcctcctcgtcccttacttcttcgacgccaccattccaacactggctccctcgagagagacgaagtgtttgtccccaagaagaaatccgacatcaagtggtacgcaaattacctcaacaacccgctaggactcacggtgatgctaaccgtccagttcacgctcggctgccctttgtacttag

SEQ ID NO: 15705 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacatcgacgccaccattccaacactggctcactcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15706 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 15707 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgtcctttgtacttag

SEQ ID NO: 15708 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggcaaggaccgcaacaaccctttgggacgcaccgtaatgttaacgtttcagttcactcgcggctgtcctttgtacttag

SEQ ID NO: 15709 - DNA, 412 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcggtggacctctcaactctcccgccaccgtgagcaaggcctccagagcgcgtgcgtcatcgacgccaccattccaacactggctccctcgagagagacgaagtgtttgtccccaagaagaagtcagacatcaagtggtacggcaagtgcctcaacaaccctttgggacgcaccgtgatgttaacggttcaggtcactctcgcctgccctgagtacttag

SEQ ID NO: 15710 - DNA, 332 bp, Artificial
  Mutation in BnaA.FAD2.a introduced by TALE nuclease pair BnFAD2_T02
cctcttctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaactggctccctcgagagagacgaagtgtttgtccccaagaagaagtcagacatcaagtggtacggcaagtacctcaacaaccctttgggacgcaccgtgatgttaacggttcagttcactctcggctgcccttggtacttag

SEQ ID NO: 15711 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgtacagtcatcgacgccaccattccaacactggctccctcgagagagacgaagtgtttgtccccaagaagaagtcagacatcaagtggtacggcaagtacctcaacagccctgtgggacgcaccgtgatgttaaaggttcagttcactctcggctggcctttgtacgtag

SEQ ID NO: 15712 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccaagagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15713 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 15714 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgggatgttaacggtgcagttcactcccggctggcctttgtacttag

SEQ ID NO: 15715 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15716 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtacagtcatcgacgccaccattccaacactggctccctcgagagagacgaagtgtttgtccccaagaagaagtcagacatcaagtggtacggcaagtacctcaacaaccctttgggacgcaccgtgatgctaaccggccagttcacgctcggctggcctttgtacttag

SEQ ID NO: 15717 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15718 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggctggccttggtacttag

SEQ ID NO: 15719 - DNA, 357 bp, Artificial
  Mutation in BnaA.FAD2.a introduced by TALE nuclease pair BnFAD2_T02
cctctcctccctcaccctctctcctacttcgcctggactctctactgggcctgccagggctgcgtcctaaccggcgtctgggtcatagcccacgagtgcggccaccacgccttcagcgactaccagtggcttgacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtaccgcaacaaccctttgggacgcaccgtgaggttaacgggtcatttctctcgcgcctgccctgagtacttag

SEQ ID NO: 15720 - DNA, 352 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgaccaccagtggctggacgacaccgtcggcctcatcttccactccttcctcctcgtcccttacttctcctggaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 15721 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtgactggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15722 - DNA, 355 bp, Artificial
  Mutation in BnaA.FAD2.a introduced by TALE nuclease pair BnFAD2_T02
cctctcctccctcaccctttctcctacttcgcctggcctctctactgggcctgccaagggtgcgtcctaaccggcgtctgggtcatagcccacgagtgcggccaccacgccttcagcgtctaccagtggctggacgacaccgtcggcctcatcttccactccttcctcctcgtcccttacttctcctggaatcatcgacgccaccattccaatactggctccctcgagagagacgaagtgtttgtccccaagaagaaatccgacatcaagttgtacggaaagtacctcaacaacccgcgaggacgcacggtgatgctaaccggccatttcacgcgcggctggccttagtacttag

SEQ ID NO: 15723 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttaagttcactctcggctggcctttgtacttag

SEQ ID NO: 15724 - DNA, 398 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatgcccgaggcatagactgtaccccaaaaaaacagtcataagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttagg

SEQ ID NO: 15725 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtactaaccggcgtctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15726 - DNA, 312 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 15727 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacgccgtgggcctcgtcttccactccttcccctcgtcccttacttctcctgcatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 15728 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtgcttag

SEQ ID NO: 15729 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaaatccgacatcaagtggtacggaaagtacctcaacaaccctttgggacgcaccgtgatgttaacggtgcagttcactctcggctggcctttgtacttag

SEQ ID NO: 15730 - DNA, 387 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctgggcctggcacagcaccggcaacagccgctggacagtcatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15731 - DNA, 357 bp, Artificial
  Mutation in BnaA.FAD2.a introduced by TALE nuclease pair BnFAD2_T02
cctctcctccctcaccctctctcctacttcgcctggcatctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgggatgttaacggtgcatttcactctcggctgcccttagtacttag

SEQ ID NO: 15732 - DNA, 335 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacacagtcggcctcattttccactccttcctcctcgtcccttactcaccattccaacactggctccctcgagagagatgaagtgttcgtccccaagaagaaatccgacatcaagtggtacggcaagtacctcaacaaccctttgggacgcaccgtgatgttaacggttcagttcactcgcggctgccctttgtacttag

SEQ ID NO: 15733 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgccctttgtacgtag

SEQ ID NO: 15734 - DNA, 357 bp, Artificial
  Mutation in BnaA.FAD2.a introduced by TALE nuclease pair BnFAD2_T02
cctctcccccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15735 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgtggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttagtacttag

SEQ ID NO: 15736 - DNA, 355 bp, Artificial
  Mutation in BnaA.FAD2.a introduced by TALE nuclease pair BnFAD2_T02
cctctcctccctcaccctctctcctacttcgtctggcctctcgactgtgcctgacagggctgcgtcctaaccaccgtctgggtcatagcccacgagtgcggccaccacgccttcagcgactaccagtggctggacgacaccgtcggcctcatcttccactccttcctcccgtcccttacttctcctggaagtcatcgacgccaccattccaacactggctccctcgagagagacgaagtgtttgtccccaagaagaagtcagacatcaagtggtgcggcaggtactcgaacacgtctgatgggcgcaagatgcagctaacccttccgctcactctcggctggcctttgtacttag

SEQ ID NO: 15737 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagctcacgagtgcggccaccacgccttcagcgactaccagtggctgcacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15738 - DNA, 360 bp, Artificial
  Mutation in BnaA.FAD2.a introduced by TALE nuclease pair BnFAD2_T02
cctctccttcctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacgtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggcgggccttggtacttag

SEQ ID NO: 15739 - DNA, 357 bp, Artificial
  Mutation in BnaA.FAD2.a introduced by TALE nuclease pair BnFAD2_T02
cccctcctccctcaccctctctcctacttcgcctggcctctctaatgggcctgccagggctgcgtcctaaccggcgtctgggtcatagcccacgagtgcggccaccacgccttcagcgactaccagtggctggacgacaccgtcggcctcatcttcctctccttcctcctcgtcccttacttctcctggaaagtcatcgacgccaccattccaacactggctccctcgagagagacgaatggtttttccccaagaagaagtcaaacatcaagtgttacggcaatgaccgcaacaaccctttgggacgcgccgagatgttagcgcttcagataagtctaggctggccttaggacttag

SEQ ID NO: 15740 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 15741 - DNA, 340 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtccctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15742 - DNA, 352 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgtcatcgacgccaccattccaacactggctccctcgagagagacgaagtgtttgtccccaagaagaagtcagacatcaagtggtacggcaagtacctcaacagccctttgggacgcacagtgatgttaacggttcagttcactctcggctggcctttgtacttag

SEQ ID NO: 15743 - DNA, 336 bp, Artificial
  Mutation in BnaA.FAD2.a introduced by TALE nuclease pair BnFAD2_T02
cctctcctccctcaccctctctcctacttcgcctagcctctctactgggcctgccagggctgcgtcctaacgggcgtctgggtcatagcccacgagtgcggccaccacgccttcagcgactaccagtggctggacgacaccgtcggtctcatcttccactccttcctcctcgtcatcgacgccaccattccaacactggctccctcgagagagacgaagtgtttgtccccaagaagaagtcagacatcaagtggtacggcaagtacctcaacacccctgtgggacgcaccgggatgtcaacggttccgttccctctcggctggcctttgtacttag

SEQ ID NO: 15744 - DNA, 391 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcatcttccactccttccaccaccagcaatattggtggcaagcaggcgctggagacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15745 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctccagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 15746 - DNA, 310 bp, Artificial
  Mutation in BnaA.FAD2.a introduced by TALE nuclease pair BnFAD2_T02
cctctcctccctcaccctttcccttacctcgcctggcccctctactgggcctgccagggctgcgtcctaaccggcgtctgggtcatagcccacgagtgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 15747 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgttaatggttcagttcactctcggctggcctttgtacttag

SEQ ID NO: 15748 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15749 - DNA, 414 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggagaccccccagcaggtggtggccatcgccagcaataatggtggcaagcaggcgctggagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15750 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctgcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactcgcggctggcctgtgtacttag

SEQ ID NO: 15751 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15752 - DNA, 355 bp, Artificial
  Mutation in BnaA.FAD2.a introduced by TALE nuclease pair BnFAD2_T02
cctctcctccctcaccctctctcctacttcgcctggactctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggtgcatttcactctcggctggccgttgtacttag

SEQ ID NO: 15753 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15754 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctgccctttgtacttag

SEQ ID NO: 15755 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15756 - DNA, 347 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttatccatgacgccaccattccaacaccggatccctcgatagggacgaagtgttcgtccccaagaagaaatccgacatcaagtggtacggcaagtacctcaacaacccgctaggacgcgcggggatgctaaccgtccagtgcaagctcggctggcctttgtacttag

SEQ ID NO: 15757 - DNA, 354 bp, Artificial
  Mutation in BnaA.FAD2.a introduced by TALE nuclease pair BnFAD2_T02
cctctcctccctcaccctctctcctacttcgcctggcctctctcctaggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcatcgacgccaccattccaacactggctcactcgagagagacgaagtgtttgtccccaagaagaaatccgacatcaagtggtacggaaagtacctcaacaacccgctaggacgcatggggatgctaaccgtccagttcacgctcggctggcctttgtacttag

SEQ ID NO: 15758 - DNA, 344 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 15759 - DNA, 357 bp, Artificial
  Mutation in BnaA.FAD2.a introduced by TALE nuclease pair BnFAD2_T02
cctctcctccctcaccctgtatcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagtgcacgctcggctggcctttgtacttag

SEQ ID NO: 15760 - DNA, 356 bp, Artificial
  Mutation in BnaA.FAD2.a introduced by TALE nuclease pair BnFAD2_T02
cctctcctccctcaccctctctcctacttcgcctggactctctacttagcctgccagggctgcgtcctacccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgtgggacgcaccgtgatgttaccggttcagttcactctcggctggcctttgtacttag

SEQ ID NO: 15761 - DNA, 357 bp, Artificial
  Mutation in BnaA.FAD2.a introduced by TALE nuclease pair BnFAD2_T02
cctctcctccctcaccctctcccttacctcgcctggccactctcctgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttctccccaagaagaagtcagacatcaagtggtacggcaagtacctcaacatccctctggaacgccccgtgatgtaaacggttcagttcacgctcggctggccttagtacttag

SEQ ID NO: 15762 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgaatgcggccaccacgccttcagcgactaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgccctttgtacttag

SEQ ID NO: 15763 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaaagtacagtcatcgacgccaccattccaacactggctccctcgagagagacgaagtgtttgtccccaagaagaagtcagacatcaagtggtacggcaagtacctcaacaaccctttgggacgcgccgtgatgttaacggtgcagttcactcgcggctggcctttgtacttag

SEQ ID NO: 15764 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaatcgacgccaccattccaacactggctccctcgagagagacgaagtgtttgtccccaagaagaagtcagacatcaagtggtacggcaagtacctcaacaaccctttgggacgcaccgtgatgttaacgtttcatttcactctcggctggcctgtgtacttag

SEQ ID NO: 15765 - DNA, 448 bp, Artificial
  Mutation in BnaA.FAD2.a introduced by TALE nuclease pair BnFAD2_T02
cctctcctccctcaccctctctcctacttcgtctggcctctctactgggcctgccaggtctgcgccctaaccggcgtctgggtcatagcccacgagtgcggccaccacgccttcagcgactaccagtggctggacgacaccgtcggcctcatcttccactccttcctcctcgtcccttacttctccttgaagtactccagcgcctgcttgccgccatcgtggctggcgatggccaccacctgctccggggtcaagccgtgggcctggcacagcaccggcaacagtcatcgacgccaccattccaacaccggatccctcgagagggatgaagtgttcgtccccaagaagaaagccgacatcaagtggtccggaaagtagctcaacaccccggtaggacgcacggtgatgctaatcctccagttcacgctcggctggcctttgtacttag

SEQ ID NO: 15766 - DNA, 363 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagctaccaccagtggctggacgacgccgtgggcctcgtcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15767 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggatacagtcatcgacgccaccattccaacactggctccctcgatagagacgaagtgtttgtccccaagaagaagtcagacatcaagtggtacggcaagtacctcaacaacccttggggacgcgccgtgatgttaacggttcatttcgctctcggctggcctttgtacttag

SEQ ID NO: 15768 - DNA, 347 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttatccatgacgccaccattccaacaccggatccctcgatagggacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 15769 - DNA, 394 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggacgccattgctggcgatggccaccacctgctggggggtcagtcatcgacgccaccattccaaaactggctcactcgagagagacgaagtgtttgtccccaagaagaagtcagacatcaagtggtacggaaagtacctcaacaacccgctaggacgcccggtgatgctaaccgtccagttcacgctcggctgccatttgtacttag

SEQ ID NO: 15770 - DNA, 417 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtccacgatcacgccgtagtcgatgggggagcccaatcctgttgccggtcttgcgatgattatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15771 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaatatcgacgccaccattccaacactggctccctcgagagagacgaagtgtttgtccccaagaagaagtcagacatcaagtggtacggcaagtacctcaacaacccgctaggacgcaccgtgatgttaacggttcagttcactctcggctggcctttgtacttag

SEQ ID NO: 15772 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15773 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagccatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 15774 - DNA, 386 bp, Artificial
  Mutation in BnaA.FAD2.a introduced by TALE nuclease pair BnFAD2_T02
cctctcctcctcaccctctctcatacttcgcctggcccctctcctgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccaagccccccagcaggtggtggccatcgccagcaatagtcatcgacgccaccattccaacactggctccctcgagagagacgaagtgtttgtccccaagaagaagtcagacatcaagtggtacggcaagtacctcaacacccctttggggcgcacagtgatgttaacggttcagttccctctcggctggcctttgtacttag

SEQ ID NO: 15775 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgctgccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15776 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgaatgcggccaccacgccttcagcgaccaccagtggctggacgacgccgtgggcctcgtcttccactccttcctcctcgtcccttacttctcctggaagtatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15777 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacatcgacgccaccattccaacactggctccctcgagagagacgaagtgtttgtccccaagaagaagtcagacatcaagtggtacgccaagtacctcaacaaccctttgggacgcaccgtgatgttaacggttcagttcactctcggctggcctttgtacttag

SEQ ID NO: 15778 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgagtacttag

SEQ ID NO: 15779 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacactggctccctcgagagagacgaagtttttgtccccaagaagaagtcagacatcaagtggtacggcaagtacctcaacaaccctttgggacgcaccgtgatgttaacggttcagttcactctcggctggcctttgtacttag

SEQ ID NO: 15780 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15781 - DNA, 339 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15782 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctgttggacgcaccgtgatgttatcggttcagttcgctctcggctggccttcgtacttag

SEQ ID NO: 15783 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagccctcgagtgcgcccaccacgccttcagctactaccagtgcctggacgacaccgtcggcctcatctcccactccttccccctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactcgcggctggcctttgtacttag

SEQ ID NO: 15784 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 15785 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacgtcatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggctggcctttgtacttag

SEQ ID NO: 15786 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcatcgacgccaccattccaacactggctccctcgagagagacgaagtgtttgtccccaagaagaagtcagacatcaagtggtacggcaaggacctcaacaaccctttgggacgcaccgtgatgttaacgggtcagttcactctcggctggcctttgtacttag

SEQ ID NO: 15787 - DNA, 358 bp, Artificial
  Mutation in BnaA.FAD2.a introduced by TALE nuclease pair BnFAD2_T02
cctctcctccctcaccctctctcctacttcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15788 - DNA, 468 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagggaccgtctccagcgcctgcttgccaccattattgctggcgatggccaccacctgctggggggtcaagccgtgggcctggcacagcaccggcaacagccgctggaccgtctccagcgcctgctaacaatccaacactggctccctcgagagagacgaagtgtttgtccccaagaagaagtcagacatcaagtggttcggcaagtaccccaacaagcctgttgggtgcaaggtgatgttaaccgttcagctccctctcggctggcctttgtacttag

SEQ ID NO: 15789 - DNA, 341 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaaattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15790 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaacaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15791 - DNA, 423 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttactttccagcgcctgcttgccgccatcgtggctggcgatggccaccacctgctggggggtcaagccgtgggcctggcacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15792 - DNA, 425 bp, Artificial
  Mutation in BnaA.FAD2.a introduced by TALE nuclease pair BnFAD2_T02
cctctcctccctcaccctctctcctacttcgcctggcctctctaatgcgcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcccttaacgtgagttacgcgtcgttccactgagcgtcagaccccgtagaaaagatcaaaggatcttcgtggtcgacgccaccattccaacactggctccctcgagagagacgaagtgtttgtccccaagaagaagtcagacatcaagtggtacggcaaggaccgcaacaaccctttgggacgcaccttgatgttaacgggtcatgtctctctcgtctgtcctttgtgcttag

SEQ ID NO: 15793 - DNA, 441 bp, Artificial
  Mutation in BnaA.FAD2.a introduced by TALE nuclease pair BnFAD2_T02
cctctcctccctcaccctctctcctacttcgcctggcctctctactgggcctaccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtgtgccaggcccacggcttgaccccccagcaggtggtggccatcgccggccagcaacgtcggttcgagatggcgctcgatgacagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactcccggctggcctttgtacttag

SEQ ID NO: 15794 - DNA, 273 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacaaatgcggccaccacgccatcgacgccaccattccaacactggctccctcgagagagacgaagtgtttgtccccaagaagaagtcagacatcaagtggtacggcaagtacctaaacaaccctttgggacgcaccgtgatgttaacggttcagttcactctcggctggcctttgtacttag

SEQ ID NO: 15795 - DNA, 355 bp, Artificial
  Mutation in BnaA.FAD2.a introduced by TALE nuclease pair BnFAD2_T02
cctctcctccctcaccctctctcctacttcgcctagcctctctactgggcctgccaagggtgcgtcctaaccggcgtctgggtcatcgcccacgaatgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15796 - DNA, 318 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagtagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15797 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagtcatcgacgccaccattccaacactggctccctcgagagagacgaagtgtttgtccccaagaagaagtcagacatcaagtggtacggcaagtacctcaacaacactttgggacgcaccgggatgttaacggttcagttcactctcggctggcctttgtacttag

SEQ ID NO: 15798 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaatcgacgccaccattccaacactggctccctcgagagagacgaagtgtttgtccccaagaagaagtcagacatcaagtggtacggcaagtacctcaacaaccctttgggacgcaccgtgatgttaacggttcagctcactctcggctggcctttgtacttag

SEQ ID NO: 15799 - DNA, 412 bp, Artificial
  Mutation in BnaA.FAD2.a introduced by TALE nuclease pair BnFAD2_T02
cctctcctccctcaccctctctcctacttcgcctggcctctctcctgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcggtggacctctcaactctcccgccaccgtgagcaaggcctccagagcgcgtgcgtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 15800 - DNA, 363 bp, Artificial
  Mutation in BnaA.FAD2.a introduced by TALE nuclease pair BnFAD2_T02
cctctcctccctcaccctctctcctacttcgcctggccactctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 15801 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaggtgtttgtccccaagaagaagtcagacatcaagtggtacggcaagtacctcaacaaccctttgggacgcaccgtgatgttaacggttcagttcactctcggctggcctttgtacttag

SEQ ID NO: 15802 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15803 - DNA, 356 bp, Artificial
  Mutation in BnaA.FAD2.a introduced by TALE nuclease pair BnFAD2_T02
cctctcctccctcaccctctcccttacctcgcctggcccctctactcggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacgattcagttcactctcggctggcctttgtacttag

SEQ ID NO: 15804 - DNA, 354 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15805 - DNA, 357 bp, Artificial
  Mutation in BnaA.FAD2.a introduced by TALE nuclease pair BnFAD2_T02
cctctcctccctcaccctctctcctacttcgcctggactctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 15806 - DNA, 478 bp, Artificial
  Mutation in BnaA.FAD2.a introduced by TALE nuclease pair BnFAD2_T02
cctctcctccctcaccctctctcctacttcgcctggcctctctcctgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggagtagcggctgttgccggtgctgtgccaggcccacggcttgaccccccagcaggtggtggccatcgccagcaataatggtggcaagcaggcgctggagacggtccagcggctgttgccggtgcagtcatcgacgccaccattccaacactggctccctcgagagagacgaagtgtttgtccccaagaagaagtcagacatcaagtggtacggcaagtacctcaacaaccctttgggacgcaccgtgattttaacggttcagttcactctcggctggcctttgtacttag

SEQ ID NO: 15807 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccatttgggacgcaccgtgatgttaacggttcagttcactctcggctggcctttgtacttag

SEQ ID NO: 15808 - DNA, 356 bp, Artificial
  Mutation in BnaA.FAD2.a introduced by TALE nuclease pair BnFAD2_T02
cctctcctccctcaccctctctcctacttcgcctggcctctctcctgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacgacaggtacctcaacaaccctttgggacgcaccgtgatgttaacggttcagttcactctcggctggcctttgcacttag

SEQ ID NO: 15809 - DNA, 364 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtattacagtcatcgacgccaccattccaacactggctccctcgagagagacgaagtgtttgtccccaagaagaagtcagacatcaagtggtacggcaattacctcaacaaccctttgtgacgcagcgtgatgttaacggttcagttcactctcggctgccctgagtacttag

SEQ ID NO: 15810 - DNA, 355 bp, Artificial
  Mutation in BnaA.FAD2.a introduced by TALE nuclease pair BnFAD2_T02
cctctcctccctcaccctctcccttacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggctgggcttagtacttag

SEQ ID NO: 15811 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 15812 - DNA, 312 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcgacgccaccatgccaacacaggctccctcgagagagacgaagtgtttgtccccaagaagaagtcagacatcaagtggtacggcaagtacctcaacaaccctttgggacgcaccgtgatgttaacggttcagttcactctaggctggcctttgtacttag

SEQ ID NO: 15813 - DNA, 312 bp, Artificial
  Mutation in BnaA.FAD2.a introduced by TALE nuclease pair BnFAD2_T02
cctctcctccctcaccctctctcctacttcgcttggcctctctactgggcctgccagggctgcgtcctaaccggcgtctgggtcatagcccacgagtgcggccaccacgccttcagcgactaccagtggctggacgacaccgtcggcctcatcgacgccaccattccaacactggctccctcgagagagacgaagtgtttgtccccaagaagaagtcagacatcaagtggtacggcaagtacctcaacaaccctgtgggacgcaccgtgaagttaacggttcagttcactctcggctggcctttgtacttag

SEQ ID NO: 15814 - DNA, 312 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcgacgccaccattccaacactggctccctcgagagagacgaagtgtttgtccccaagaagaagtcagacatcaagtggtacggcaagtacctcaacaaccctttgggacggaccgtgatgttaacggttcagttcactctaggctggcctttgtacttag

SEQ ID NO: 15815 - DNA, 318 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 15816 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggaaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15817 - DNA, 362 bp, Artificial
  Mutation in BnaA.FAD2.a introduced by TALE nuclease pair BnFAD2_T02
cctctcctccctcaccctctccattacctcgcctggcccctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaagtaacagtcatcgacgccaccattccaacactggctccctcgagagagacgaagtgtttgtccccaagaagaagtcagacatcaagtggtacggcaagtacctcaacaaccctttgggacgcaccttgatgttaacggttcagttcactctcggctggcctttgtacttag

SEQ ID NO: 15818 - DNA, 359 bp, Artificial
  Mutation in BnaA.FAD2.a introduced by TALE nuclease pair BnFAD2_T02
cctctcctccctcaccctctccattacctcgcctggcccatctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctctgctggcctttggacttag

SEQ ID NO: 15819 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactta

SEQ ID NO: 15820 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcgtcttccactccttcctcctcgtcccttacttctcctggaagtaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15821 - DNA, 386 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagcaatattggtggcaagcaggcgctgtcgggttatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 15822 - DNA, 359 bp, Artificial
  Mutation in BnaA.FAD2.a introduced by TALE nuclease pair BnFAD2_T02
cctctcctccctcaccctctctcctacttagcctagcctctctactgggcctaccaagggtgcgtcctaaccggcttctgggtcatagcccacgagtgcggccaccacgccttcagcgaccaccagtggctggacgacgccgtgggcctcgtcttccactccttcctcctcgtcccttacttctcctggaagaagccatcgacgccaccattccaacaccggatccctcgagagagacgaagtgtttgtccccaagaagaagtcagacatcaagtggtccggcaagtacctcaacagccctttgggtctcacagtcatgttaacggttcagtgctctctcggctggcctttatacttag

SEQ ID NO: 15823 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 15824 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15825 - DNA, 348 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 15826 - DNA, 315 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgaatgcggccaccacgccttcagcgactaccagtggctggacgacaccgtcggcctcatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15827 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttggacttag

SEQ ID NO: 15828 - DNA, 393 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtacaacactggctccctcgagagagacgaagtgtttgtcatcgacgccaccattccaacactggctccctcgagagagacgaagtgtttgtccccaagaagaagtcagacatcaagtggtacggcaagtacctcaacaaccctttgggatgcaccgtgatgttaacggttcagttcactctcggctggcctttgtacttag

SEQ ID NO: 15829 - DNA, 349 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15830 - DNA, 344 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttcaccggcgccaccattccaacactggctccctcgagagggacgaagtgtttgtccccaggaagaagtcagacatcaagtggtacggcaagtacctcaacaaccctttgggacgcaccgggatgttaacggttcgtttcattctgggctgcctttgtacttag

SEQ ID NO: 15831 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaagcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15832 - DNA, 352 bp, Artificial
  Mutation in BnaA.FAD2.a introduced by TALE nuclease pair BnFAD2_T02
cctctcctccctcaccctatctactacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15833 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15834 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctggggcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15835 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 15836 - DNA, 312 bp, Artificial
  Mutation in BnaA.FAD2.a introduced by TALE nuclease pair BnFAD2_T02
cctctcctccctcaccctctctcctacttcgcctggcctctctcctgggcctgccaagggtgcgtcctaaccggcgtctgggtcatagcccacgagtgcggccaccacgccttcagcgactaccagtggctggacgacaccgtcggcctcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggcctttgtacttag

SEQ ID NO: 15837 - DNA, 362 bp, Artificial
  Mutation in BnaA.FAD2.a introduced by TALE nuclease pair BnFAD2_T02
cctctcctccctcaccctctctcctacttcgcctggcctctctaatgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaacaaacagccatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactcgcggctggcctttgtacttag

SEQ ID NO: 15838 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgaccaccagtggctggacgacgccgtgggcctcgtcttccactccttcctcctcgtcccttacttctcctggaaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15839 - DNA, 357 bp, Artificial
  Mutation in BnaA.FAD2.a introduced by TALE nuclease pair BnFAD2_T02
cctctcctccctcaccctctccattacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacatccctttgggacgcaccgtgatgttaacggttcagtgcacgctcggctggcctttgtacttag

SEQ ID NO: 15840 - DNA, 318 bp, Artificial
  Mutation in BnaA.FAD2.a introduced by TALE nuclease pair BnFAD2_T02
cctctcctccctcaccctttccattacctcgcctggccactctactgcgcctgccaaggctgcgtcctaacccgcctctgggtcatcgcccacgaatgcgcccaccacgccttcagcgactaccagtggctggacgacaccgtcggcctcatcttccactccttcctcctcgtcccttacttctcctggaagtagacgaagtgtttgtccccaagaagaagtcagacatcaagtggtacggcaaggacctcaacaaccctttgggacgccccgtgatgttaacggttcatttcactctctgctgcccgttggacttag

SEQ ID NO: 15841 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15842 - DNA, 442 bp, Artificial
  Mutation in BnaA.FAD2.a introduced by TALE nuclease pair BnFAD2_T02
cctctcctccctcaccctctctcctactgcgcctggcctctctactgggcctacaagggctgcggcctcaccggcgtctgggtcatagcccacgagtgcggccaccacgccttcagcgactaccagtggctggacgacaccgtcggcctcatcttccactccttcctcctcgtcccttacttctcctggaagtacaggtcgttcgctccaagctgggctgtgtgcacgaaccccacgttcagccttctacagcgcggagaatctcgctctccccacagtcatcgacgccaccattccaacactggctccctcgagagagacgaagtgtttgtccccaagaagaagtcagacatcaagtggtacggcaagtacctcaacacccctgtgtgacgcaccgtgatgttaacggttcagtccactctcggctggcctttgtacttag

SEQ ID NO: 15843 - DNA, 347 bp, Artificial
  Mutation in BnaA.FAD2.a introduced by TALE nuclease pair BnFAD2_T02
cctctcctccctcaccctctctcctacttcgcctggcctctctcctgagcctgccagggctgcgtcctaaccggcgtctgggtcatagcccacgagtgcggccaccacgccttcagcgactaccagtggcttgacgacaccgtcggtctcatcttccactccttcctcctcgtcccttacttctccacgacgccaccattccaacactggctccctcgagagagacgaagtgtttgtccccaagaagaagtcagacatcaagtggtacggcaagtacctcaacaaccctttgggacgcaccgtgattttaacggttcagttcacgctcggctggcctttgtacttag

SEQ ID NO: 15844 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgcctcagcgaccaccagtggctggacgacgccgtgggcctcgtcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15845 - DNA, 357 bp, Artificial
  Mutation in BnaA.FAD2.a introduced by TALE nuclease pair BnFAD2_T02
cctctcctccctcaccctctctcctacttcgcctggcctccctactgggcctgccagggctgcgtcctaacgggcctctgggtcatagcccacgagtgcggccaccacgccttcagcgactaccagtggcttgacgacaccgtcggtctcatctcccactccttcctcctcgtcccttacttctcctggaaagtcatcgacaccaccattccaacactggctccctcgagagagacgaagtgtttgtccccaagaagaagacagacatcaagtggtacggcgagtacctcaacatcctttggggacgaaccgggatattaacggtgcagttcactctcggctggacatggtacttag

SEQ ID NO: 15846 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgatagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15847 - DNA, 336 bp, Artificial
  Mutation in BnaA.FAD2.a introduced by TALE nuclease pair BnFAD2_T02
cctctcctccctcaccctgtctcctacttcgcctggcctctctactcggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggaaagtacctcaacaacccgctaggacgcacggggattctaaccgtccaggtcacgctcggctggccgtggtacttag

SEQ ID NO: 15848 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtctcttacttctcctggaatgtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 15849 - DNA, 353 bp, Artificial
  Mutation in BnaA.FAD2.a introduced by TALE nuclease pair BnFAD2_T02
cctctcctccctcaccctctctcctacttcgcctggcctctctcctgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaacctgttgggacgcaccgtgatgttaacggtgcagttcactcgtggctggcctttgtacttag

SEQ ID NO: 15850 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggcttgacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15851 - DNA, 318 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagagagatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15852 - DNA, 357 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgaatgcggccaccacgccttcagcgaccaccagtggctggacgacgccgtgggcctcgtcttccactccttcctcctcgtcccttacttctcctggaagatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15853 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15854 - DNA, 405 bp, Artificial
  Mutation in BnaA.FAD2.a introduced by TALE nuclease pair BnFAD2_T02
cctctcctccctcaccctctaccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacggtgctgttccgggcgatctcgatcagctcgatgtactcgtgggacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacta

SEQ ID NO: 15855 - DNA, 357 bp, Artificial
  Mutation in BnaA.FAD2.a introduced by TALE nuclease pair BnFAD2_T02
cctctcctccctcaccctctctcctacttcgcctcgcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacgggtcagtgcactctcggctggcctttgtacttag

SEQ ID NO: 15856 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgtgaacggttcagttcactctcggctggcctttgtacttag

SEQ ID NO: 15857 - DNA, 354 bp, Artificial
  Mutation in BnaA.FAD2.a introduced by TALE nuclease pair BnFAD2_T02
cctctcctccctcaccctctcccttacctcgcctggcccctctactgggcctgtcaaggctgcgtcctaacgggcctctgggtcatcgcccacgaatgcggccaccacgccttcagcgaccaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcacggtgatgctaaccgtccagttcactctcggctggcctttgtacttag

SEQ ID NO: 15858 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtcggcctcatcttccactccttcctcctcgtcccttaattctcctggacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15859 - DNA, 412 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgctgaaccacatcaccaactgcaacggcgccgtgctgtccgtggaggagctccagccatcgacgccaccattccaacactgactccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15860 - DNA, 358 bp, Artificial
  Mutation in BnaA.FAD2.a introduced by TALE nuclease pair BnFAD2_T02
cctctcctccctcaccctatctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggtcgcaccgtgatgttaacgggtcagtgcactctcggctggccttagtacttag

SEQ ID NO: 15861 - DNA, 310 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggtctcatcttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15862 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15863 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaggtgtttgtccccaagaagaagtcagacatcaagtggtacggcaagtacctcaacaaccctttgggacgcaccgtgatgttaacggttcagttcactctcggctggcctttgtacttag

SEQ ID NO: 15864 - DNA, 292 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtgtcatcgacgccaccattccaacactggctccctcgagagagacgaagtgtttgtccccaagaagaagtcagacatcaagtggtacggcaagtacctcaacaaccctttgggacgcatcgtgatgttaacggtgcagttcactctcggctggcctttgtacttag

SEQ ID NO: 15865 - DNA, 348 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtccattacttagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttaactctcggctggcctttgtacttag

SEQ ID NO: 15866 - DNA, 331 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15867 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcccggacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15868 - DNA, 318 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggcctcatcttccactccttcctccacgtcccttacttctcctggagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15869 - DNA, 352 bp, Artificial
  Mutation in BnaA.FAD2.a introduced by TALE nuclease pair BnFAD2_T02
cctctcctccctcaccctctctcctacttcgcctggccactctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggccttggtacttag

SEQ ID NO: 15870 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgtgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 15871 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 15872 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 15873 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacatcaacacacttctgggtcgcaccgtgatgtaaacggttcagttcactctcggctggccttagtacttag

SEQ ID NO: 15874 - DNA, 460 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcctctgggtcatcgcccacgagtgcggccaccacgccttcagcgaccaccagtggctggacgacgccgtcggcctcatcttccactccttcctcctcgtcccttacttctcctggagcgatggccaccacctgctggggggtcaagccgtgggcctggcacagcaccggcaacagccgctggaccgtctccagcgcctgcttgccaccgccattgctggcgatggtcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15875 - DNA, 356 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 15876 - DNA, 352 bp, Artificial
  Mutation in BnaA.FAD2.a introduced by TALE nuclease pair BnFAD2_T02
cctctcctccctcaccctctctcctacttcgcctggcctctctactgagcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctgtcatcgacgccaccattccaacactggctccctcgagagggatgaagtgtttgtccccaagaagaagtcagacatcaagtggtacggcaagtacctcaacaacccgttgggacgcaccgtgatgttaacggtgcagttcactctctgctggcctttgtacttag

SEQ ID NO: 15877 - DNA, 330 bp, Artificial
  Mutation in BnaA.FAD2.a introduced by TALE nuclease pair BnFAD2_T02
cctctcctccctcaccctctctcctacttcgcctggactctctactgggcctgccagggctgcgtcctaaccggcgtctgggtcatagcccacgagtgcggccaccacgccttcagcgactaccagtggctggacgacaccgtcggcctcatcttccactccttcctcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggctggcctttgtacttag

SEQ ID NO: 15878 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccttgaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15879 - DNA, 339 bp, Artificial
  Mutation in BnaA.FAD2.a introduced by TALE nuclease pair BnFAD2_T02
cctctcctccctcaccctgtctcctacttcgcctggactctctcctgggcctgccagggatgcgtcctaaccggcgtctgggtcatagcccacgagtgcggccaccacgccttcagcgactaccagtggctggaagacaccgtcggcctcatcttccactccttcctcctcgtcccttacttctccaccatttcaacactggcttcctcgagagagacgaagtgtttgtccccaagaagaagtcagacatcaagtggtacggcaagtacctcaacgaccctttgggacgctccgtgatgttaacggttcaggtcactctcggctggcctttgtacttag

SEQ ID NO: 15880 - DNA, 356 bp, Artificial
  Mutation in BnaA.FAD2.a introduced by TALE nuclease pair BnFAD2_T02
cctctcctccctcaccctctcccttacctcgcctggaccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15881 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgattttaacggttcagttcactctcggctggcctttgtacttag

SEQ ID NO: 15882 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccaagggtgcgccctaaccggcgtctgggtcatagcccacgagtgcggccaccacgccttcagcgactaccagtggctggacgacaccgtcggcctcatcttccactccttcctcctcgtcccttacttctcctgaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15883 - DNA, 356 bp, Artificial
  Mutation in BnaA.FAD2.a introduced by TALE nuclease pair BnFAD2_T02
ccttcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15884 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagttggttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 15885 - DNA, 318 bp, Artificial
  Mutation in BnaA.FAD2.a introduced by TALE nuclease pair BnFAD2_T02
cctctcctccctcaccctctctcctacttcgcctgccctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15886 - DNA, 356 bp, Artificial
  Mutation in BnaA.FAD2.a introduced by TALE nuclease pair BnFAD2_T02
cctctcctccctcaccctgtctcctacttcgcctggactcactactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaaatccgacatcaagtggtacggaaagtacctcaacagcccgctaggacgcgcggggttgctaaccgtgcagttcactctcggctggccgttgtacttag

SEQ ID NO: 15887 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcatttgtacttag

SEQ ID NO: 15888 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15889 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacatcgacgccaccattccaacactggttccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15890 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggaatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15891 - DNA, 353 bp, Artificial
  Mutation in BnaA.FAD2.a introduced by TALE nuclease pair BnFAD2_T02
cctctcctccctcaccctctctcctacttcgcctggcctctctcctgggcctgccagggctgcgtcctaaccggcgtctgggtcatagcccacgagtgcggccaccacgccttcagcgactaccagtggctggacgccaccgtcggcctcatcttccactccttcctcctcgccccttacttctccttgtcatcgacgccaccattccaacactggctccctcgagagagacgaagtgtttgtccccaagaagaagtcagacatcaagtggtacggcaagtacctcaacaaccctttgggacgcaccgtgaggtaaacggttcagttcacgctcggatggccttagtacttag

SEQ ID NO: 15892 - DNA, 345 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgcattcagcgactaccagtggctggacgacaccgtcggcctcatcttccactccttcctcctcgtcccttacttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15893 - DNA, 357 bp, Artificial
  Mutation in BnaA.FAD2.a introduced by TALE nuclease pair BnFAD2_T02
cctctcctccctcaccctctcccttacctcgcctcgcccctcccctgggcctgccaaggctgcgtcctcacgggcctctgggtcatcgcccacgaatgcggccaccccgccttcagcgaccaccagtggctggacgacgccgtgggcctcgtcttccactccttcctcctcgtcccttacttctcctggaagatcatcgacgccaccattccaacactggctccctcgagagagacgaagtgtttgtccccaagaagaagtcagacatcaagtggtacggcaagtacctcaacaaacctttgcgacgcaccgtgatgttaacggttcagttcagtctcggctggcctttgtacttag

SEQ ID NO: 15894 - DNA, 345 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttcttcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15895 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggctggcctttgtacttag

SEQ ID NO: 15896 - DNA, 358 bp, Artificial
  Mutation in BnaA.FAD2.a introduced by TALE nuclease pair BnFAD2_T02
cctctcctccctcaccctctctactacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 15897 - DNA, 347 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttatccatgacgccaccattccaacaccggatccctcgatagggacgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 15898 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttggacttag

SEQ ID NO: 15899 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacaccgtcggtctcatcttccactccttcctcctcgtcccttacttctcctggaaaagccatcgacgccaccattccaacaccggatccctcgagagtgatgaagtgttcgtccccaagaagaaatccgacatcaagtggtacggaaagtacctcaacaacccgctaggacgcacggtgatgttaacggttcagttcactctcggctggcctttgtacttag

SEQ ID NO: 15900 - DNA, 401 bp, Artificial
  Mutation in BnaA.FAD2.a introduced by TALE nuclease pair BnFAD2_T02
cctctcctccctcaccctctctcctacttcgcctggcctatctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagcaagatcgcttggcctcgcgcgcagatcagttggaagaatttgtccgtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctgtgtactg

SEQ ID NO: 15901 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 15902 - DNA, 332 bp, Artificial
  Mutation in BnaA.FAD2.a introduced by TALE nuclease pair BnFAD2_T02
cctatcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaactggctccctcgagagagacgaagtgtttgtccccaagaagaagtcagacatcaagtggtacggcaagtacctcaacaaccctttgggacgcaccgtgatgttaagggttcagttcactctcggctggcctttgtgcttag

SEQ ID NO: 15903 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactcattcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15904 - DNA, 411 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacagagcgaggtatgtaggcggtgctacagagttcttgaagtggtggcctacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15905 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctgaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15906 - DNA, 336 bp, Artificial
  Mutation in BnaA.FAD2.a introduced by TALE nuclease pair BnFAD2_T02
cctctcctccctcaccctctctcctacttcgcctggccaccctaataggcctgccaagggtgcgtcctaaaaggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgggatgttaacggtgcagttcactcgcggctggcctttgtacttag

SEQ ID NO: 15907 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 15908 - DNA, 383 bp, Artificial
  Mutation in BnaA.FAD2.a introduced by TALE nuclease pair BnFAD2_T02
cctctcctccctcaccctctaccttacctcgcctggcctctctactgggcctgccagggctccgtcctaaccggcgtctgggtcatagcccacgagtgcggccaccacgccttcagcgactaccagtggctggacgacaccgtcggcctcatcttccactccttcctcctcgtcccttacttctcctggaagactgagcctttcgttttatttgatgcgtcatcgacgccaccattccaacactggctccctcgagagagacgaagtgtttgtccccaagaagaagtcagacatcaagtggtacggcaaggaccgcagcaaccctttgggacgcaccgtggtgtcaacggttcagttctctctcggctggcctttgtacttag

SEQ ID NO: 15909 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtgatccggcaattaccccaacgcccctgtggggcgcaccgtgatgttaacgcttccgttcactctcggctggcctttgtacttag

SEQ ID NO: 15910 - DNA, 335 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttactcaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 15911 - DNA, 358 bp, Artificial
  Mutation in BnaA.FAD2.a introduced by TALE nuclease pair BnFAD2_T02
cctctcctccctcaccatctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacacccctttgggacgcaccgtgatgttaacggttcagttctctctcggttggccgtggtacgtag

SEQ ID NO: 15912 - DNA, 347 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15913 - DNA, 360 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaaggcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15914 - DNA, 352 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggcatcgacaccaccattccaacactcgctccctcgagagatacgaagtgtttgtcccctagaagaagtcccacatcaattggtacggcaagtacctcaacaaccctttgggacgcaccgtgatgttaacggttcagttcactctcggctggcctttgtacttag

SEQ ID NO: 15915 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgcctttgtacttag

SEQ ID NO: 15916 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15917 - DNA, 318 bp, Artificial
  Mutation in BnaA.FAD2.a introduced by TALE nuclease pair BnFAD2_T02
cctctcctccctcaccctctctcctacttcgcctggcctctctactgggcctgccagggctgcgccctaaccggcgtctgggtcatagcccacgagtgcggccaccacgccttcagcgactaccagtggcttgacgacaccgtcggtctcatcttccactccttcctcctcgtcccttacttctcctggagagagacgaagtgtttgtccccaagaagaagtcagacatcaagtggtacggcaagtacctcaacaaccgtttgggacgcaccgtgagtttaacggttcagttcactctcggctggccttagtacttag

SEQ ID NO: 15918 - DNA, 355 bp, Artificial
  Mutation in BnaA.FAD2.a introduced by TALE nuclease pair BnFAD2_T02
cctctcctccctcaccctctcccttacctcgcctggccactctactgcgcctgccaaggctgcgtcctaacgggcctctgggtcatcgcccacgaatgcgtccaccacgccttcagcgaccaccagtggctggacgaccccgtgggcctcgtcttccactccttcctcctcgtcccttacttctcctggagtcatcgacgccaccattccaacactggctccctcgagagagacgaagtgtttgtccccaagaagaagtcagacatcaagtggtacggcaagtgcctcaacaaccctttgggacgcaccgagatgtaaacggttcatttcactctggtgtggcctttttacttag

SEQ ID NO: 15919 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaaggcagacatcaagtggtacggcaagtacctcaacaaccgtgtgggacgcaccgtgatgttaacggttcaggtcactctcggctggcctttgtacttag

SEQ ID NO: 15920 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacaacccgctaggacgcaccgtgatgttaacggttcagttcactctcggctggcctttgtacttag

SEQ ID NO: 15921 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttacactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggctggcctttgtacttag

SEQ ID NO: 15922 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagtgtcatcgacgccaccattccaacactggctccctcgagagagacgaagtgtttgtccccaagaagaagtcagacatcaagtggtacggcaagtacctcaacatccctttgggacgcaccgtgatgttaacggttcagttcactctcggctggcctttgtacttag

SEQ ID NO: 15923 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccttggggacgcaccgtgatgttaacggtgcagttcactctcggctggcctttgtacttag

SEQ ID NO: 15924 - DNA, 354 bp, Artificial
  Mutation in BnaA.FAD2.a introduced by TALE nuclease pair BnFAD2_T02
cctctcctccctcaccctctctcctacttcgcctggccaccctcatgggcctcccaaggctgcgtcctaaccggcgtctgggtcatcgcccacgagtgcggccaccacgccttcagcgactaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctctgctggccatcgtacttag

SEQ ID NO: 15925 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15926 - DNA, 359 bp, Artificial
  Mutation in BnaA.FAD2.a introduced by TALE nuclease pair BnFAD2_T02
cctctcctccctcaccctctctcctacttcgcctggccactctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15927 - DNA, 346 bp, Artificial
  Mutation in BnaA.FAD2.a introduced by TALE nuclease pair BnFAD2_T02
cctctcctcccacaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15928 - DNA, 358 bp, Artificial
  Mutation in BnaA.FAD2.a introduced by TALE nuclease pair BnFAD2_T02
cctctccttcctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15929 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctctcagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15930 - DNA, 356 bp, Artificial
  Mutation in BnaA.FAD2.a introduced by TALE nuclease pair BnFAD2_T02
cctctcctccctcaccctctcccttacctcgcctggccactctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 15931 - DNA, 365 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacaccgtcggcctcatcttccactccttcctcctcgtcccttacttctcctggaagtaactacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15932 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaagtcatcgacgccaccattccaacactggctccctcgagagagacgaagtgtttgtccccaagaagaagtcaggcatcaagtggtacggcaagtacctcaacaaccctttgggacgcaccgtgatgttaacggttcagttcactctcggctggcctttgtacttag

SEQ ID NO: 15933 - DNA, 358 bp, Artificial
  Mutation in BnaA.FAD2.a introduced by TALE nuclease pair BnFAD2_T02
cctctcctccctcaccctctctcctacttcgcctagcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 15934 - DNA, 409 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaccttgaccgaacgcagcggtggtaacggcgcagtggcggttttcatggcttgagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15935 - DNA, 356 bp, Artificial
  Mutation in BnaA.FAD2.a introduced by TALE nuclease pair BnFAD2_T02
cctctcctccctcaccctctctcctacttcgcctggcctgtctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggtcgcaccgtcaggtcaacggttcagttcactcgcggctggcctttgtacgtag

SEQ ID NO: 15936 - DNA, 382 bp, Artificial
  Mutation in BnaA.FAD2.a introduced by TALE nuclease pair BnFAD2_T02
ctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagactgagcctttcgttttatttgatgcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15937 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgagtgcggccaccacgccttcagcgactaccagtggctggacgacaccgtcggcctcatcttccactccttcctcctcgtcccttacttctcctggaatcatcgacgccaccattccaacactggctccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 15938 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgtcatcgacgccacattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15939 - DNA, 356 bp, Artificial
  Mutation in BnaA.FAD2.a introduced by TALE nuclease pair BnFAD2_T02
cctctcctccctcaccctctctactacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15940 - DNA, 336 bp, Artificial
  Mutation in BnaA.FAD2.a introduced by TALE nuclease pair BnFAD2_T02
cctctcctccctcaccctctatcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15941 - DNA, 357 bp, Artificial
  Mutation in BnaA.FAD2.a introduced by TALE nuclease pair BnFAD2_T02
cctctcctccctcaccctctctcctacttcgcctggcctctccactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacagccctttgggacgcaccgtggtgttaacggttcagttcgctctcggctggcctttgtacttag

SEQ ID NO: 15942 - DNA, 323 bp, Artificial
  Mutation in BnaA.FAD2.a introduced by TALE nuclease pair BnFAD2_T02
cctctcctccctcaccctttctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaagtaccgctcgccgcagccgaacgaccgagaagaagtcagacatcaagtggtacggcaagtacctcaacaaccctttgggacgcaccgtgatgttaacggttcagttcactctcggctggcctttgtacttag

SEQ ID NO: 15943 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 15944 - DNA, 355 bp, Artificial
  Mutation in BnaA.FAD2.a introduced by TALE nuclease pair BnFAD2_T02
cctctcctccctcaccctgtccattacctcgcctggcccctctcctgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15945 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15946 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggcttgacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15947 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15948 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagttgctggacgacgccgtgggcctcgtcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15949 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactacagtggctggacgacgccgtcggcctcatcttccactccttcctcctcgtcccttacttctccatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15950 - DNA, 324 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15951 - DNA, 340 bp, Artificial
  Mutation in BnaA.FAD2.a introduced by TALE nuclease pair BnFAD2_T02
cctctcctccctcaccctctctcctacttcgcctggcctctctcctgggcctgccagggctgcgtcctaaccggcgtctgggtcatagcccacgagtgcggccaccacgccttcagcgactaccagtggctggacgacaccgtcggcctcatcttccactccttcctcctcgtcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15952 - DNA, 310 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 15953 - DNA, 359 bp, Artificial
  Mutation in BnaA.FAD2.a introduced by TALE nuclease pair BnFAD2_T02
cctctcctccctcaccctctctcctacttcgcctggcctctctactgcgcctgccagggctgcgtcctaaccggcgtctgggtcatagcccacgagtgcggccaccacgccttcagcgactaccagtggcttgacgccaccgtcggtctcaacttccactccctcctcctcgtcccttacttctcctggaaacagccatcgacgccaccattccaacaccggatcccccgagagggatgaagtgttcgtccccaagaagaaatccgacatcaagtggtacggcaagtacctcaacatccctttgggacgcaccgtgatgttaacggttcagttcactctcggctggcctttgtacttag

SEQ ID NO: 15954 - DNA, 427 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacaaggcggtaatacggttatccacagaatcaggggataacgatatcgatgctgtccatgtgctgtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 15955 - DNA, 356 bp, Artificial
  Mutation in BnaA.FAD2.a introduced by TALE nuclease pair BnFAD2_T02
cctctcctccctcaccctgtctcctacttcgcctggcctctccactgggcctgccaagggtgcgtcctaacaggcgtctgggtcatagctcacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagacgaagtcagacatcaactggtacggcaggtaccccagcatcccttcgggacgcgccgtggtttaaacggctcgagtcacgctgcggtgcccttagcacctag

SEQ ID NO: 15956 - DNA, 362 bp, Artificial
  Mutation in BnaA.FAD2.a introduced by TALE nuclease pair BnFAD2_T02
cctctcctccctcaccctctctcctacttcgcctggactctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtacagtcatcgacgccaccattccaacactggctccctcgagagagacgaagtgtttgtccccaagaagaagtcagacatcaagtggtacggcaagtacctcaacaaccctgtgggacgcgccgtgattttaacggttcagttcactctcggctggccgttgtacttag

SEQ ID NO: 15957 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggctggcctttgtacttag

SEQ ID NO: 15958 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 15959 - DNA, 366 bp, Artificial
  Mutation in BnaA.FAD2.a introduced by TALE nuclease pair BnFAD2_T02
cctctcctccctcaccctctctcctacttcgcctggactctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtacaatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 15960 - DNA, 356 bp, Artificial
  Mutation in BnaA.FAD2.a introduced by TALE nuclease pair BnFAD2_T02
cctctcctccctcaccctctcccttacctcgcctggccactctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 15961 - DNA, 451 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtacacgtctccagcggctgttgccggtgctgtgccaggcccacggcttgaccccccagcaggtggtggccatcgccagcaatggcggtggtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15962 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaactcatcgacgccaccattccaacactggctccctcgagagagacgaagtgtttgtccccaagaagaagtcagacatcaagttgtacggcaagtacctcaacaaccctttgggacgcaccgtgatgttaacggttcagttcactctcggctggcctttgtacttag

SEQ ID NO: 15963 - DNA, 352 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15964 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgtgggacgcgccgtgatgttaacggttccgttctctctcggctggcttttgtacttag

SEQ ID NO: 15965 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacaatggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 15966 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcgctctcggctggcctttgtacttag

SEQ ID NO: 15967 - DNA, 346 bp, Artificial
  Mutation in BnaA.FAD2.a introduced by TALE nuclease pair BnFAD2_T02
cctctcctccctcaccctctctcctacttcgcctggcctctctcctgagcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagcaggcaatccaacactggctccctcgagagagacgaagtgtttgtccccaagaagaagtcagacatcaagtggtacggcaagtacctcaacaaccctttgggacgcaccgtgatgttaacggtgcagttcactctcggctggccttagtacttag

SEQ ID NO: 15968 - DNA, 357 bp, Artificial
  Mutation in BnaA.FAD2.a introduced by TALE nuclease pair BnFAD2_T02
cctctcctccctcaccctctcccttacctcgcctggcccctctcctgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttcatcgacgccaccattccaacactggctccctcgagagagacgaagtgtttgtccccaagaagaagtcagacatcaagtggtacggcaagtacctcaacaacccggggggacgcaccgggatgttaacggttcagttcacgctcggctggcctttgtacttag

SEQ ID NO: 15969 - DNA, 406 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaacagcaggtggtggccatcgccagcaatggcggtggcaagcaggcgctggagttatcgacgccaccattccaacactggctccctcgagagagacgaagtgtttgtccccaagaagaagtcagacatcaagtggtacggcaagtacctcaacaaccctttgggacgcaccgtgatgttaacggtccagttcactctcggctggcctttgtacttag

SEQ ID NO: 15970 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgttcccaagaagaagtcagacatcaagtggtacggcaagtacctcaacaaccctttgggacgcaccgtgatgttaacggttcagttcactctcggctggcctttgtacttag

SEQ ID NO: 15971 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtgcctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggccgttgtacttag

SEQ ID NO: 15972 - DNA, 336 bp, Artificial
  Mutation in BnaA.FAD2.a introduced by TALE nuclease pair BnFAD2_T02
cctctcctccctcaccctctctcctacttcgcctggcatctctcctgagcctgccagggctgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaacccgttgggacgcaccgtgatgttaacgttgcagttcactctcggctggcctgtgtacttag

SEQ ID NO: 15973 - DNA, 358 bp, Artificial
  Mutation in BnaA.FAD2.a introduced by TALE nuclease pair BnFAD2_T02
cctctcctccctcaccctgtctcctacttcgcctagcaactctcctcggcctgccagggctgcgtcctaaccggcgtctgggtcatcgcccacgagtgcggccaccacgccttcagcgaccaccagtggctggacgacgccgtgggcctcgtcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacagccttgtgggaagcatcgtgattttaacggtgaaggtcactttcggctggcgtttttccttag

SEQ ID NO: 15974 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtccacacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacactggctccctctagagagacgaagtgtttgtccccaagaagaagtcagacatcaagtggtacggcaagtacctcaacaaccctttgggacgcagcgtgatgttaacggttcagttcactcccgcctggccttggtacttag

SEQ ID NO: 15975 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgtcatcgacgccaccattccaacactggctccctcgagagagacgaagtgtttgtccccaagaagaagtcagacatcaagtggtacggcaagtaccccaacacccctgtgggacgcaccgtgatgttaacggttcagttcactctcggctggcctttgtacttag

SEQ ID NO: 15976 - DNA, 291 bp, Artificial
  Mutation in BnaA.FAD2.a introduced by TALE nuclease pair BnFAD2_T02
cctctcctccctcaccctctcccttacctcgcctggcccctctaccgggcctgccaaggctgcgccctaaccggcgtctgggtcatagcccacgagtgcggccaccacgccttcagcgactaccagtggctggacgacaccgtcggaagactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15977 - DNA, 353 bp, Artificial
  Mutation in BnaA.FAD2.a introduced by TALE nuclease pair BnFAD2_T02
cctctcctccctcaccctctctcctacttcgcctggcctctctactgagcctgccagggctgcgtcctaaccggcgtctgggtcatagcccacgcgtgcggccaccacgccttcagcgactaccagtggctggacgacaccgtcggcctcatcttccactccttcctcctcgtcccttactactcctggtcatcgacgccaccattccaacactggctccctcgagagagacgaagtgtttgtccccaagaacaaatccgacatcaagtggtacggaaagtacctcaacaacccgctaggacgcacggtgatgctaaccgtccagttcacgctcggcttgcctttgtacttag

SEQ ID NO: 15978 - DNA, 324 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 15979 - DNA, 357 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttcatcgacgccaccattccaacactggctccctcgagagagacgaagtgtttgtccccaagaagaagtcagacatcaagtggtccggcaagtacctcaacaaccgtttgggacgcaccgtgatgttaacggttcagttcgctctcggctggcctttgtacttag

SEQ ID NO: 15980 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15981 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggttcggcaagtacctcaacaacccgctaggacgcacggtgatgctaaccgtccagttcacgctcggctggcctttgtacttag

SEQ ID NO: 15982 - DNA, 356 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 15983 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggccgttgtacttag

SEQ ID NO: 15984 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcccggctggcctttgtacttag

SEQ ID NO: 15985 - DNA, 357 bp, Artificial
  Mutation in BnaA.FAD2.a introduced by TALE nuclease pair BnFAD2_T02
cctctcctccctcaccctgtctcctacttcgcctggcctctctactgcgcctgtcagggctgcgtcctaaccggcgtctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctgtgggacgcgccgtgatgttaacggttcagttcactctcggctggccgttgtacttag

SEQ ID NO: 15986 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacggcgccgttaacctcgtcttccactcctttctcctcgtcccttacttctcctggaagtcatcgacgccaccattccaacactcgctccctcgagagagacgaagtgtttgtccccaagaagaagcctgacatcgagtggtacggcaagtacctcagcatccctttgagacgcaccgtgatgttaaccgttcaggtcactctcggcgggcctttgcgcttag

SEQ ID NO: 15987 - DNA, 352 bp, Artificial
  Mutation in BnaA.FAD2.a introduced by TALE nuclease pair BnFAD2_T02
cctctcctccctcaccctctcccttacctcgcctggcccctctcctgggcctgccaaggctgcgtcctaacgggcctctgggtcatcgcccacgaatgcggccaccacgccttcagcgaccaccagtggctggacgacaccgtgggcctcgtcttccactccttcctcctcgtcccttacttctcctggaatcgacgccaccattccaacaccggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15988 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagcagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 15989 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcgaccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 15990 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgacttcagcgaccaccagtggctggacgacgccgtgggcctcgtcttccactccttcctcctcctcccttacttctcctggaagttgtcatcgacgccacctttccaacactggctccctcgagagagacgaagtgtttgtccccaagaagaagtcaaacatcgagtggtaccgcgagtacctcaacaaccctttggaacgcaccgtgatgtaaacggttcagttcactctcggctgcccttagtacttag

SEQ ID NO: 15991 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaatgtcatcgacgccaccattccaacactggctccctcgagagagacgaagtgtttgtccccaagaagaagtcagacatcaagtggtacggcaagtacctcaacaacccttgtggacgcaccgtgatgtcagcggtgcatttcactctcggctggcctttggacttag

SEQ ID NO: 15992 - DNA, 356 bp, Artificial
  Mutation in BnaA.FAD2.a introduced by TALE nuclease pair BnFAD2_T02
cctctcctccctcaccctctctcctacttcgcctggcctctctactgagcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15993 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 15994 - DNA, 357 bp, Artificial
  Mutation in BnaA.FAD2.a introduced by TALE nuclease pair BnFAD2_T02
cctctcctccctcaccctctctcctacttcgcctggcctctctactgagcctgccagggctgcgtcctaaccggcgtctgggtcatagcccacgagtgcggccaccacgccttcagcgactaccagtggctggacgacaccgtcggcctcatcttccacttcttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggcctttgtacttag

SEQ ID NO: 15995 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagtgcacgctcggctggcctttgtacttag

SEQ ID NO: 15996 - DNA, 351 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctccttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 15997 - DNA, 350 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggtctcatcttccactccttcctcctcgtcccttactaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 15998 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggataaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctgtgtacttag

SEQ ID NO: 15999 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16000 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgcctccagcgactaccagtggcttgacgacaccgtcggcctcatcttccactccttcctcctcgtcccttacttctcctggaagcagtcatcgacgccaccattccaacactggctccctcgagagagacgaagtgtttgtccccaagaataagtcagacatcaagtggtacggcaagtacctcaacaacccgctaggacgcacggtgatgctaaccgtccagttcacgctcggctggccttagtacttag

SEQ ID NO: 16001 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtaaggcacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 16002 - DNA, 381 bp, Artificial
  Mutation in BnaA.FAD2.a introduced by TALE nuclease pair BnFAD2_T02
cctctcctccctaccctctctcctacttcgcctggcctctctactgggcctgccagggctgcgtcctaaccggcgtctgggtcatagcccacgagtgcggccaccacgccttcagcgactaccagtggctggacgacaccgtcggcctgggtcaagttgagcggggcacccgtcagtgcattgcgccatgcaggcggcaagcaggcgctggagacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacgtag

SEQ ID NO: 16003 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 16004 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagccaacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16005 - DNA, 354 bp, Artificial
  Mutation in BnaA.FAD2.a introduced by TALE nuclease pair BnFAD2_T02
cctctcctccctcaccctctcccttacctcgcctggaccctctactgggcctgccaaggctgcgtcctaacgggcctcttggtcatcgcccacgaatgcggccaccacgccttcagcgaccaccagtggctggatgacgccgtgggcctcgtcttccactccttcctcctcgtcccttacttctcctggagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctagtacttag

SEQ ID NO: 16006 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagacaccatcgacgcctccattccaacaccggatccctcgagagggatgaagtgtttgtccccaagaagaagtcagacatcaagtggtacggcaagtacctcaacacccctttgggacgcactgtgatgtaaaccgtccatttcacgctcggctggcctttgtacttag

SEQ ID NO: 16007 - DNA, 311 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtcttag

SEQ ID NO: 16008 - DNA, 360 bp, Artificial
  Mutation in BnaA.FAD2.a introduced by TALE nuclease pair BnFAD2_T02
cctctcctccctcaccctctccattacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaagtcatcgacgccaccattccaacactggctccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 16009 - DNA, 355 bp, Artificial
  Mutation in BnaA.FAD2.a introduced by TALE nuclease pair BnFAD2_T02
cctctcctccctcaccctctctactacttcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttggacttag

SEQ ID NO: 16010 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggccacatcttccactccttcctccacgtcccttacttctcctggaagtcatcgacgccaccattccaacactggctccctcgagagagacgaagtgtttgtccccaagaagaagtcagacatcaagtggtacggcaagtacctcaacaaccctttggaacgcaccgtgatgttaacggttcagttcactctcggctggccattgtacttag

SEQ ID NO: 16011 - DNA, 358 bp, Artificial
  Mutation in BnaA.FAD2.a introduced by TALE nuclease pair BnFAD2_T02
cctctcctccctcaccctctcccttacctcgcctgccccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 16012 - DNA, 359 bp, Artificial
  Mutation in BnaA.FAD2.a introduced by TALE nuclease pair BnFAD2_T02
cctctcctccctcaccctctctcctacttcgcctggcatctttcctgggcctgccagggctgcgtcctaaccgccgtctgggtaatagcccacgagtgcggccaccacgccttcagctacttccagtggcttgacgacaccgtcggtctcatcttccacgccttcctcctcgtcccttacttctcctggaagtagtcatcgacgccaccatgccaacactggctccctcgagagagacgaagtgtttgtccccaagaagaagtcagacatcaagtggtacggcaagtgcctcaacaaccctttgggactcaccgtgatgttaacgtttcagttcactctcggctgccctttgtacttag

SEQ ID NO: 16013 - DNA, 336 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgactccgtgggcctcgtcttccactccttcctcctcgtcatcgacgccaccattccaacactggctccctcgagagagacgaagtgtttgtccccaagaagaagtcagacatcaagtggtacggcaagtacctcaacaaccctttgagacgcaccgtgatgttaacccttcagttcactctcggctggcctttgtgcttag

SEQ ID NO: 16014 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgtagtgtttgtccccaagaagaagtcagacatcaagtggtacggaaagtacctcaacaacccgctaggacgcacggtgatgctaaccgtccagttcatgctcggctggcctttgtacttag

SEQ ID NO: 16015 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggtcatcgacgccaccattccaacactggctccctcgagagagacgaagtgtttgtccccaagaagaagtcagacatcaagtggtatggcaagtacctcaacaaccctttgggacgcaccgtgatgttaacggttcagttcactctcggctggcctttgtacttag

SEQ ID NO: 16016 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttttacttag

SEQ ID NO: 16017 - DNA, 367 bp, Artificial
  Mutation in BnaA.FAD2.a introduced by TALE nuclease pair BnFAD2_T02
cctctcctccctcaccctctatactacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacacacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttggacttag

SEQ ID NO: 16018 - DNA, 357 bp, Artificial
  Mutation in BnaA.FAD2.a introduced by TALE nuclease pair BnFAD2_T02
cctctcctccctcaccctctcccttacctcgccggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16019 - DNA, 362 bp, Artificial
  Mutation in BnaA.FAD2.a introduced by TALE nuclease pair BnFAD2_T02
cctctcctccctcaccctctttcctacttcgcctggactctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16020 - DNA, 391 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcatctgggtcatagcccacgagtgcggccaccacgccttcagcgactaccagtggctggacgacaccgtcggcctcatcttccactccttcctcctcgtcccttacttctcctggaagtgtaggtcgttcgctccaagctgggctgtgtgcacgaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16021 - DNA, 354 bp, Artificial
  Mutation in BnaA.FAD2.a introduced by TALE nuclease pair BnFAD2_T02
cctctcctccctcaccctctctcctacttcgcctggcctctctactcggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctgtgggacgcaccgtgaggttaacggttcaggtcactctcggctggccgttgtacttag

SEQ ID NO: 16022 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaagatcatcgacgccaccattccaacactggctccctcgagagagacgaagtgtttgtccccaagaagaagtcagacatcaagtggtacggcaagtacctcaacaaccctttgggacgcaccgtgatgttaacgcttcagttcactctcggctggcctttgtacttag

SEQ ID NO: 16023 - DNA, 353 bp, Artificial
  Mutation in BnaA.FAD2.a introduced by TALE nuclease pair BnFAD2_T02
cctctcctccctcaccctctcccttacctcgcctggcccctctaatgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16024 - DNA, 356 bp, Artificial
  Mutation in BnaA.FAD2.a introduced by TALE nuclease pair BnFAD2_T02
cctctcctccctcaccctctcccttacctcgcctggccactctactgggcctgccaaggctgcgtcctaacgggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16025 - DNA, 366 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacaatcataaaaggtccactgggttcgtgccttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16026 - DNA, 358 bp, Artificial
  Mutation in BnaA.FAD2.a introduced by TALE nuclease pair BnFAD2_T02
cctctcctccctcaccctcttccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgtggtacttag

SEQ ID NO: 16027 - DNA, 357 bp, Artificial
  Mutation in BnaA.FAD2.a introduced by TALE nuclease pair BnFAD2_T02
cctctcctccctcaccctctcccttacctcggctggccactctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctctgggacgcaccgtgatgttaacggttcagttcactctcggctggccgttgtacttag

SEQ ID NO: 16028 - DNA, 346 bp, Artificial
  Mutation in BnaA.FAD2.a introduced by TALE nuclease pair BnFAD2_T02
cctctcctccctcaccctctcccttacctcgcctggcccctctcctgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggcgccaccattccaacactggctccctcgagagagacgaagtgtttgtccccaagaagaagtcagacatcaagtggtacggcaagtacctcaacaaccctttgtgacgcaccgtgaggttaagggttcagttcactctcggctggcctttgtacttag

SEQ ID NO: 16029 - DNA, 357 bp, Artificial
  Mutation in BnaA.FAD2.a introduced by TALE nuclease pair BnFAD2_T02
cctctcctccctcaccctctcccttacctcgcatggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacagcaagtacctcaacaaccctttgggacgcaccgtgatgttaacggttcagttcactctcggctggcctttgtacttag

SEQ ID NO: 16030 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 16031 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 16032 - DNA, 411 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacgcataccgctagccaggaagagtttgtagaaacgcaaaaaggccatccccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16033 - DNA, 387 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggccccccagcaggtggtggccatcgccagcaatagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16034 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtctccaagaagaagtcagacatcaagtggtacggcaagtacctcaacaaccctttgggacgcaccgtgatgttaacggttcagttcacgctcggctggcctttgtacttag

SEQ ID NO: 16035 - DNA, 356 bp, Artificial
  Mutation in BnaA.FAD2.a introduced by TALE nuclease pair BnFAD2_T02
cctctcctccctcaccctctctcctacttcgcctggcctctctcctgagcctgccaagggtgcgtcctaaccggcgtctgggtcatagcccacgagtgcggccaccacgccttcagcgactaccagtggctggccgacgccgtgggcctcgtctcccactccttcctcctcgtcccttacttctcctggaagtcatcgacgccaccattccaacactggctccctcgagagagacgaagtgtttgtccccaagaaggagacagacatcaagtggttcggcaagtacctcaacatccctttggaaggcaccgtggggttaacggttcaggtcacgctcggctggcctttgtacttag

SEQ ID NO: 16036 - DNA, 362 bp, Artificial
  Mutation in BnaA.FAD2.a introduced by TALE nuclease pair BnFAD2_T02
cctctcctccctcaccctctcacttacctcgcctagcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaacagtcatcgacgccaccattccaacactggctccctcgagagagacgaagtgtttgtccccaagaagaagtcagacatcaagtggtacggcaagtacctcaacaacccttttggacgcaccgtgatgttaacggttcagttcactctcggctggcctttgtacttag

SEQ ID NO: 16037 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttccgtcatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 16038 - DNA, 356 bp, Artificial
  Mutation in BnaA.FAD2.a introduced by TALE nuclease pair BnFAD2_T02
cctctcctccctcaccctctcacttacctcgcctgccccctctactgggcctgccaaggctgcgtcctaccgggcctctgggtcatagcccacgagtgcggccaccacgccttcagcgactaccagtggcttgacgacaccgtcggcctcatcttccactccttcctcctcgtcccttacttctcctggacctcatcgacgccaccattccaacactggctccctcgagagagacgaagtgtttgtccccaagaagaagtcacacaccaagtggtacggcacgtacctcaacctgcgtttggcatgcacagggatgggaacagttcagctcacgctgggctgtcctttgtacttag

SEQ ID NO: 16039 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgactaccagtggctggacgacaccgtcggcctcatcttccactccttcctcctcgtccattacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16040 - DNA, 365 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttcctccacgtcccttacttctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16041 - DNA, 397 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccagcggtggtttgtttgccggaaaaagagttggtacagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 16042 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcgagtggtacggcaagtacctcaacaacccgctaggacgcacggtgatgctaaccgtccagttcacgctcggctggcctttgtacttag

SEQ ID NO: 16043 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacatccctttgggacgcaccgtgatgttaacggtgcagttcactctcggctggcctttgtacttag

SEQ ID NO: 16044 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacacccctttgggacgcaccgtgatgttaacggttccgttcactctcggctggcctttgtacttag

SEQ ID NO: 16045 - DNA, 346 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 16046 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacatccctttgggacgcaccgtgatgttaaccgtccagttcacgctcggctggcctttgtacttag

SEQ ID NO: 16047 - DNA, 402 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcaagccgtgggcctggcacagcaccggcaacagccgctggaccgtctcctacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16048 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaatgtcatcgacgccaccattccaacactggctccctcgagagagacgaagtgtttgtccccaagaagaaggcagacatcaagtggtacggcaagtacctcaacaaccctttgggacgcaccgtgatgttaacggttcagttcactctcggctggcctttgtacttag

SEQ ID NO: 16049 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacgtttcagttcactctaggctggcctttctacttag

SEQ ID NO: 16050 - DNA, 357 bp, Artificial
  Mutation in BnaA.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16051 - DNA, 443 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtaggcgatggccaccacctgctccggggtcaagccgtgggcctggcacagcaccggcaacagcgcctgcaccgtctccagcgcctagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16052 - DNA, 357 bp, Artificial
  Mutation in BnaA.FAD2.a introduced by TALE nuclease pair BnFAD2_T02
cctctcctccctcaccctctctcctacttcgcctggcctctctactgcgcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgccctttatacttag

SEQ ID NO: 16053 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaactgttcagttcactctcggctggccgttgtacttag

SEQ ID NO: 16054 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttgagttcactctctgctgtcctttgtacttag

SEQ ID NO: 16055 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggcctcatcttccactccttcctcctcgtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 16056 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 16057 - DNA, 471 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactcctacctcctcgtcccttacttctcctggaagtcgccagccacgatggcggcaagcaggcgctggagacggtccagcggctgttgccggtgctgtgccgggcgatggccaccacctgctccggggtcaagccgtgggcctggcacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16058 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatggtaacagttcagttcactctcggctgtccgttgtacttag

SEQ ID NO: 16059 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggctcagttcactctcggctggcctttgtacttag

SEQ ID NO: 16060 - DNA, 362 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16061 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaaccctgtgggacgcaccgtgatgttaacggttcagttcactctcggctggcctttgtacttag

SEQ ID NO: 16062 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagctaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 16063 - DNA, 353 bp, Artificial
  Mutation in BnaA.FAD2.a introduced by TALE nuclease pair BnFAD2_T02
cctctcctccctcaccctctctcctacttcgcctggcctctcaactgggcctgccagggctgcgtcctaaccggcgtctgggtcatagcccacgagtgcggccaccacgccttcagcgaccaccagtggctggacgacgccgtgggcctcatcttccactccttcctcctcgtcccttacttctcctagtcatcgacgccaccattccaacactggctccctcgagagagacgaagtgtttgtccccaagaagaagtcagacatcaagtggtacggcaagtacctcaacagccctttgggacgcaccgtgatgttaacggttcaggtcactctcggctgtccgttgtacttag

SEQ ID NO: 16064 - DNA, 310 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttccctctcggctggcctttgtacttag

SEQ ID NO: 16065 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcctcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16066 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggcgggcctttgtacttag

SEQ ID NO: 16067 - DNA, 344 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacaccattccaacactggctccctcgagagagacgaagtgtttgtccccaagaagaagtcagacatcaagtggtacggcaagtacctcaacaaccgtctgggatgcaccgtgatgtgaacggttcagttcactctcggctggcctttgtacttag

SEQ ID NO: 16068 - DNA, 358 bp, Artificial
  Mutation in BnaA.FAD2.a introduced by TALE nuclease pair BnFAD2_T02
cctctcctccctcaccctctctcccacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagggatgaagtgttcgtccccaagaagaaatccgacaccaagtggtacgtaaagtacctcaacaacccgctaggacgcacggtgatcctaaccgtccagttcactctcggctggcctttacacttag

SEQ ID NO: 16069 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgtgggacgcaccgtgatgttaacggtgcagttcactctcggctggcctttgtacttag

SEQ ID NO: 16070 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 16071 - DNA, 425 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcccttaacgtgagttacgcgtcgttccactgagcgtcagaccccgtagaaaagatcaaaggatcttcttggtcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggccgttgtacttag

SEQ ID NO: 16072 - DNA, 359 bp, Artificial
  Mutation in BnaA.FAD2.a introduced by TALE nuclease pair BnFAD2_T02
cctctcctccctcaccctctctcctacttcgcctggcctctctactgagcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtggtgttaacggttcagttcactctcggctggcctttgtacttag

SEQ ID NO: 16073 - DNA, 356 bp, Artificial
  Mutation in BnaA.FAD2.a introduced by TALE nuclease pair BnFAD2_T02
gctctcctccctcaccctctcccttacctcgcctggcccctctactgggccggccaagggtgcgtcctaaccggcgtctgggtcatagcccacgagcgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 16074 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagccatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggctggcctgtgtacttag

SEQ ID NO: 16075 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaactcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16076 - DNA, 357 bp, Artificial
  Mutation in BnaA.FAD2.a introduced by TALE nuclease pair BnFAD2_T02
cctctcctccctcaccctctcccttacctcgcctggcccctctactgcgcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16077 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcctcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16078 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggccgttgtccttag

SEQ ID NO: 16079 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctgcctttgtacttag

SEQ ID NO: 16080 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaacggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacacccctttgggacgcaccgtgatgttaacggttcagttcactctcggctggcctttgtacttag

SEQ ID NO: 16081 - DNA, 303 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcttttgtacttag

SEQ ID NO: 16082 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgattttaacggttcagttcactctcggctggcctttgtacttag

SEQ ID NO: 16083 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttggacttag

SEQ ID NO: 16084 - DNA, 448 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtactccagcgcctgcttgccgccatcgtggctggcgatggccaccacctgctccggggtcaagccgtgggcctggcacagcaccggcaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16085 - DNA, 356 bp, Artificial
  Mutation in BnaA.FAD2.a introduced by TALE nuclease pair BnFAD2_T02
cctctcctccctcaccctctcccttacctcgcccggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16086 - DNA, 413 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacaatggccaccacctgctggggggtcaagccgtgggcctggcacagcaccggcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggccgttgtacttag

SEQ ID NO: 16087 - DNA, 354 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16088 - DNA, 352 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16089 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 16090 - DNA, 399 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagccgaagtttccaaaaggtcgttgatcaaagctcgccgcgttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16091 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16092 - DNA, 343 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcccacgaatgcggccaccacgccttcagcgaccaccagtggctggacgacgccgtgggcctcgtcttccactccttcctcctcgtcccttacttcatcgacgccaccattccaacactggctccctcgagagagacgaagtgtttgtccccaagaagaagtcagacgtcaagtggtacggcaagtacctcaacaaccctttgggacgcaccgtgatgttaacggttcagttcactctcggctggccgttgtacttag

SEQ ID NO: 16093 - DNA, 357 bp, Artificial
  Mutation in BnaA.FAD2.a introduced by TALE nuclease pair BnFAD2_T02
cctctcctccctcaccctctctcctacttcgcctggcctcgctactgggcctcccaagggtgcgccctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacaccggatccctcgagagggatgaagtgttcgtccccaagaagaaatccgacatcaagtggtacggaaagtatctcaacaagcgtctaggacgcatggtgatgctaaccgtccagttcacgctcggctggcctttgtacttag

SEQ ID NO: 16094 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 16095 - DNA, 355 bp, Artificial
  Mutation in BnaA.FAD2.a introduced by TALE nuclease pair BnFAD2_T02
cctctcctccctccccctctctcctacttctcctttcctctctacttttccttccagggctgcgtcctaaccggcgtcttggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacttttcctttcactctcggctggcctttctccttct

SEQ ID NO: 16096 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagtccacgagtgcggccaccacgccttcagcgactaccagtggctggacgacaccgtcggcctcatcttccactccttcctcctcgtcccttacttccgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16097 - DNA, 383 bp, Artificial
  Mutation in BnaA.FAD2.a introduced by TALE nuclease pair BnFAD2_T02
cctctcctccctcaccctctctcctacttcgcctggcctctctactgggcctgccagggctacgtcctaaccggcgtctgggtcatagcccacgagtgcggccaccacgccttcagcgactaccagtggctggacgacaccgtcggcctcatcttccactccttcctcctcgtcccttacttctcctggaagtttgaccccggagcaggtggtggccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16098 - DNA, 356 bp, Artificial
  Mutation in BnaA.FAD2.a introduced by TALE nuclease pair BnFAD2_T02
cctctcctccctcaccctctctcctacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16099 - DNA, 348 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttagtcatcgacgccaccattccaacactggctccctcgagagagacgaagtgtttgtccccaagaagaagtcagacatcaagtggtacggcaagtacctcaacaaccctttgggacgcaccgtgatgttaacgtttcagttcactctcggctggcctttgtacttag

SEQ ID NO: 16100 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 16101 - DNA, 448 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtactccagcgcctgcttgccgccatcgtggctggcgatggccaccacctgctccggggtcaagccgtgggcctggcacagcaccggcaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16102 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgctaaccgtccagttcacgctcggctggccgttgtacttag

SEQ ID NO: 16103 - DNA, 323 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgaatgcggccaccacgccttcagcgaccaccagtggctggacgacgccgtgggcctcgtcttccactccttcctcctcgtcccttacttctcctggaagtaccgctcgccgcagccgaacgaccgagaagaagtcagacatcaagttgtacggcaagtacctcaacaaccctttgggacgcaccgtgatgttaacggttcagttcactctcggctggcctttgtacttag

SEQ ID NO: 16104 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgaggttaacgtttcagttcactctcggctggcctttgtacttag

SEQ ID NO: 16105 - DNA, 312 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 16106 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggagtcatcgacgccagcattccaacactggctccctcgagagggatgaagtgttcgtccccaagaagaaatccgacatcaagtggtgcggaaagtacctcaacaacccgctaggacgcccggtgatgctaaccgtccagttcacgctcggctagccgttgtacttag

SEQ ID NO: 16107 - DNA, 356 bp, Artificial
  Mutation in BnaA.FAD2.a introduced by TALE nuclease pair BnFAD2_T02
cctctcctccctcaccctctctcctacttcgcctgtcctctctactggtcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16108 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16109 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16110 - DNA, 347 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttatccatgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 16111 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactcctccctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 16112 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctgtgtacttag

SEQ ID NO: 16113 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 16114 - DNA, 395 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttgaccccccagcaggtggtggccatcgccagccaacagtcatcgacgccaccattccaacactggctccctcgagagagacgaagtgtttttccccaagaagaagtcagacatcaagtggtacggcaagtacctcaacaaccctttgggacgcaccgtgatgttaacggttcagttcactctcggctggcctttgtacttag

SEQ ID NO: 16115 - DNA, 357 bp, Artificial
  Mutation in BnaA.FAD2.a introduced by TALE nuclease pair BnFAD2_T02
cctctcctccctcaccctctctcctacttcgcctggcctctctcctgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgaggttaacgtttcagttcactctcggctggcctttgtactgag

SEQ ID NO: 16116 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacaacggcgagctttgatcaacgaccaccattccaacactggctccctcgagagagacgaagtgtttgtccccaagaagaagtcagacatcaagtggtacggcaagtacctcaacaaccctgtgggacgcgccgtgatgttaacggttcagtgcactctcggcgggccgttgtacttag

SEQ ID NO: 16117 - DNA, 467 bp, Artificial
  Mutation in BnaA.FAD2.a introduced by TALE nuclease pair BnFAD2_T02
cctctcctccctcaccctctctcctacttcgcctcgcctctctactgggcctgccaagggtgcgtcctaacaggcgtctgggtcatagcccacgagtgcggccaccacgccttcagcgactaccagtggctggacgacaccgtcggcctcatcttccactccttcctcctcgtcccttacttctcctggaaggcaacgtcggttcgagatggcgctcgatgacgccaactacctctgatagttatttatgcattgggttttaatgattagagtcccgcaataatacattgaagacgcgaaagggcaccgactcacccattcaaccactggctccctcgtgagagccgaagtgttggtccccaataaaaagccacacatcaagtgttacgtcaattcccccaccacccctttgggacgcaccgtgatgttaagcgttcatttcactctcggctggcctttgtacttag

SEQ ID NO: 16118 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaactctttgggacgcaccgtgatgttaacggttcagttcactctcggctggcctttgtacttag

SEQ ID NO: 16119 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagtccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 16120 - DNA, 357 bp, Artificial
  Mutation in BnaA.FAD2.a introduced by TALE nuclease pair BnFAD2_T02
ccctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcatttgtacttag

SEQ ID NO: 16121 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggctggcctttgtacttag

SEQ ID NO: 16122 - DNA, 356 bp, Artificial
  Mutation in BnaA.FAD2.a introduced by TALE nuclease pair BnFAD2_T02
cctctcctccctcaccctctctcctacttcgcctggcctctctcctgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagggatgaagtgttcgtccccaagaagaaatccgacatcaagtggtacggaaagtacctcaacaacccgctaggacgcacggtgaggctaaccgtgcagttcacgctcggctggcctttgtacgtag

SEQ ID NO: 16123 - DNA, 356 bp, Artificial
  Mutation in BnaA.FAD2.a introduced by TALE nuclease pair BnFAD2_T02
cctctcctccctcacccactctcctacttcgcctggcctctctactgagcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgtgtgacgcatcgtgatgttaacggttcagtgcactctctgcgggcctttgtacttag

SEQ ID NO: 16124 - DNA, 336 bp, Artificial
  Mutation in BnaA.FAD2.a introduced by TALE nuclease pair BnFAD2_T02
cctctcctccctcaccctctctactacttcgcctggcctctctactgagcctgccagggctgcgtcctaaccggcgtctgggtcatagcccacgagtgcgaccaccacgccttcagcgactaccagtggctggacgacaccgtcggcctcatcttccactccttcctcctcatcatcgacgccaccattccaacactggctccctcgagagagacgaagtgtttgtccccaagaagaagtcagacatcaagtggtacggcgggtacctcaacgtccctatgggacggaccgtggtggaaactctgcggttcacgctcggcggccctgtgtgcttag

SEQ ID NO: 16125 - DNA, 322 bp, Artificial
  Mutation in BnaA.FAD2.a introduced by TALE nuclease pair BnFAD2_T02
ccttcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtaccgctcgccgcagccgaacgaccgagaagaagtcagacatcaagtggtacggcaagtacctcaacaaccctttgggacgcaccgtgatgttaacggttcagttcactctcggctggcctttgtacttag

SEQ ID NO: 16126 - DNA, 360 bp, Artificial
  Mutation in BnaA.FAD2.a introduced by TALE nuclease pair BnFAD2_T02
cctctcctccctcaccctctctcctacttcgcctggcaactctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcagtcatcgacgccaccattccaacactggctccctcgagagagacgaagtgtttgtccccaagaagaagtcagacatcaagtggtacggcaagtacctcaacagccctttgggacgcaccgtgaggttaacggttcagttcactctcggctgtcctttgtacttag

SEQ ID NO: 16127 - DNA, 357 bp, Artificial
  Mutation in BnaA.FAD2.a introduced by TALE nuclease pair BnFAD2_T02
cctctcctccctcaccctctctcctactttgccttgcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16128 - DNA, 357 bp, Artificial
  Mutation in BnaA.FAD2.a introduced by TALE nuclease pair BnFAD2_T02
cctctcctccctcaccctctcccttacctcgcctcgcccctctactgagcctgccaaggctgcgtcctaccaggcctctgggtcatcgcccacgaattcggccaccacgccttcagcgaccaccagtggctggacgacgccgtgggcctcgtcttccactccttcctcctcgtcccttacttctcctggaatgtcatcgacgccaccattccaacactggctccctcgagagagacgaagtgtttgtccccaagaagaagtcagacatcaagtggtacggcaagtacctcaacatccctttgggacgcaccgtgatgttaacggttcagttcactctcggctggcctttgtacttag

SEQ ID NO: 16129 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16130 - DNA, 352 bp, Artificial
  Mutation in BnaA.FAD2.a introduced by TALE nuclease pair BnFAD2_T02
cctctcctccctcaccctatctactacttcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16131 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcgtcttccactccttcctcctcgtcccttacttctcctggaaatcatcgacgcaaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16132 - DNA, 417 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaattgttgccggtgctgtgccaggcccacggcttgaccccggagcaggtggtggccatcgccagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 16133 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgcctaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaaccgttcaggtcactctcggctgccctttgtacttag

SEQ ID NO: 16134 - DNA, 357 bp, Artificial
  Mutation in BnaA.FAD2.a introduced by TALE nuclease pair BnFAD2_T02
cctctcctccctcaccctctcccatacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaagatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16135 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16136 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggccacatcttccactccttcctcctcgtcccttacttctcctggaagtcatcgacgccaccattccaacactggctccctagagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16137 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 16138 - DNA, 356 bp, Artificial
  Mutation in BnaA.FAD2.a introduced by TALE nuclease pair BnFAD2_T02
cctctcctccctcaccctctctcctacttcgcctggcctctctactgggactgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttggtacgcaccgtgatgttaacgttgcagttcacgctcggctggcctttgtacttag

SEQ ID NO: 16139 - DNA, 321 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcatcttccactccttcctcctcgtcccttacttctcctggaagagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 16140 - DNA, 359 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16141 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcctggcctttgtgcttag

SEQ ID NO: 16142 - DNA, 405 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcctcttccactccttcctcctcgtcccttacttctcctggaagtactccagcggctgttgccaccattattgctggcgatggccaccacctgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16143 - DNA, 359 bp, Artificial
  Mutation in BnaA.FAD2.a introduced by TALE nuclease pair BnFAD2_T02
cctctcctccctcaccctctctcctacttctcctggcctctctactgggcctaccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtcccccaacacccctttgggacgcaccgggatgttaacggttcagttcactctcggctggcctttgtacttag

SEQ ID NO: 16144 - DNA, 387 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggccccccagcaggtggtggccatcgccagcaatagtcatcgacgccaccattccaacactggctccctcgagagagacgaagtgtttgtccccaagaagaagtcagacatcaagtggtacggcaagtacctcaacaaccctttgggacgcaccgtgatgggaacggttcagttcacgctcggcgggccggtgtacttag

SEQ ID NO: 16145 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16146 - DNA, 387 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctgggcctggcacagcaccggcaacagccgctggacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 16147 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctgttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 16148 - DNA, 411 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggtggcaagcaggcgctggagacggtccagcggctgttgccggtgctgtgccaggcccagtcatcgacgccaccattccaacactggctccctcgagagagacgaagtgtttgtccccaagaagaagtaagacatcaagtggtacggcaagtacctcaacaaccctttgggacgcaccgtgatgttaacggttcagttcactctcggctggcctttgtacttag

SEQ ID NO: 16149 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccctttgtacttag

SEQ ID NO: 16150 - DNA, 355 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 16151 - DNA, 416 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatctccagcgcctgcttgccgccatcgtggcccacggcttgaccccccagcaggtggtggcagtcatcgacgccaccattccaacactggctccctcgagagagacgaagtgtttgtccccaagaagaagtcagacatcaagtggtacggcaagtacctcaacaaccctttgggacgcaccgtgatgttaacgtttcagttcactctcggctggcctgtgtacttag

SEQ ID NO: 16152 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctgccctgtgtacttag

SEQ ID NO: 16153 - DNA, 324 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16154 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16155 - DNA, 315 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcatcgacgccaccattccaacactggctccctcgagagagacgaagtgtttgtccccaagaagaagtcagacatcaagtggtacggcaagtacctcaacaaccctttgtgacgcaccgtgatgttaacggttcagttcactctcggctggcctttgtacttag

SEQ ID NO: 16156 - DNA, 359 bp, Artificial
  Mutation in BnaA.FAD2.a introduced by TALE nuclease pair BnFAD2_T02
cctctcctccctcaccctctctcatacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 16157 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 16158 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccgtttgggacgcaccgtgatgtgaacgtttcagatgactctgggctggccttagtactgag

SEQ ID NO: 16159 - DNA, 417 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggccatcgcccacgaatgcggccaccacgccttcagcgactaccagtggctggacgacaccgtcggcctcatcttccactccttcctcctcgtcccttacttctcctggaaggatttgtcctactcaggagagcgttcaccgacaaacaacagataaaacgaaaggccgtcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16160 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtactgag

SEQ ID NO: 16161 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagatcatcgacgccaccattccaacactggctccctcgagagagacgaagtgtttgtccccaagaagaagtcaggcatcaagtggtacggcaagtacctcaacaaccctttgggacgcaccgtgatgttaacggttcagttcactctcggctggcctttgtacttag

SEQ ID NO: 16162 - DNA, 362 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtattag

SEQ ID NO: 16163 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctcagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 16164 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtgcttag

SEQ ID NO: 16165 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagcagtcatcgacgccaccattccaacactggctccctcgatagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 16166 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatattccactccttcctcctcgtcccttacttctcctggtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctgtgtacttag

SEQ ID NO: 16167 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaaggtcatcgacgccaccattccaacactggctccctcgagagagacgaagtgtttgtccccaagaagaaatccgacatcaagtggtacggcaagtacctcaacaaccctttgggacgcaccgtgatgttaacggttcagttcactctcggctggcctttgtacttag

SEQ ID NO: 16168 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcacgctcggctggcctttgtacttag

SEQ ID NO: 16169 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 16170 - DNA, 391 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaagtgtaggtcgttcgctccaagctgggctgtgtgcacgaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16171 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcacggtgatgctaaccatccagttcacgctcggctggcctttgtacttag

SEQ ID NO: 16172 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16173 - DNA, 318 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgaccaccagtggctggacgacgccgtgggcctcgtcttccactccttcctcctcgtcccttacttctcctggagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16174 - DNA, 273 bp, Artificial
  Mutation in BnaA.FAD2.a introduced by TALE nuclease pair BnFAD2_T02
cctctcctccctcaccctctcccttacctcgcctggcctctctactgggcctgccaaggctgcgtcctaacgggcctctgggtcatcgcccacgaatgcggccaccacgccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16175 - DNA, 356 bp, Artificial
  Mutation in BnaA.FAD2.a introduced by TALE nuclease pair BnFAD2_T02
cctctcctccctcaccctctctcctacttcgcctggcatctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcggacatcaagtggtacggcaagtacctcaacaaccctttgggacgcaccgtgatgttaacggtgcagttcactctcggctggcctttgtacttag

SEQ ID NO: 16176 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaagaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16177 - DNA, 353 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcgaccaccacgccttcagcgactaccagtggctggacgacaccgtcggcctcatcttccactccttcctcctcgtcccttacttctcctggaaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16178 - DNA, 318 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16179 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcatacatcaagtggtacggcaagtacctcaacaaccctttgggacgcaccgtgatgttaacggttcagttcactctcggctggcctttgtacttag

SEQ ID NO: 16180 - DNA, 359 bp, Artificial
  Mutation in BnaA.FAD2.a introduced by TALE nuclease pair BnFAD2_T02
cctatcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 16181 - DNA, 346 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 16182 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacaccgtcggcctcatcttccactccttcctcctcgtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 16183 - DNA, 437 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtactccagcgcctgcttgccaccattattgctggcgatggccaccacctgctggggggtcaagccgtgggcctgggtcaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 16184 - DNA, 356 bp, Artificial
  Mutation in BnaA.FAD2.a introduced by TALE nuclease pair BnFAD2_T02
cctctcctccctcaccctctctcctacttcgcctggcctctctcctgagcctgccagggctgcgtcctaacaggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttgactctcggctggcctgtgtacttag

SEQ ID NO: 16185 - DNA, 378 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggatatggcggcaagcaggcgatggagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 16186 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctacgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16187 - DNA, 356 bp, Artificial
  Mutation in BnaA.FAD2.a introduced by TALE nuclease pair BnFAD2_T02
cctctcctccctcaccctatcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaaggcagacatcaagtggtacggcaagtacctcaacaaccctttgggacgcaccgtgatgttaacggttcagttctctctcggctggcctttggacttag

SEQ ID NO: 16188 - DNA, 453 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcccactggtcggccacgggtttacacacgcgcacatcgttgcgttaagccaacacccggcagcgttagggaccgtcgctgtcaagtatcaggacatgatcgcagttcatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggctggcctttgtacttag

SEQ ID NO: 16189 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacagccctttgggacgcaccgtgaggttatcgggtcattgttctctcggctggcattagtacttag

SEQ ID NO: 16190 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaagccatcgacgccaccattccaacaccggatccctcgagagggatgaagtgttcgtccccaagaagaagtcagacatcaagtggtacggcaagtacctcaacatccctttgggacgcaccgtgatgttaacagttcagtgcacgctcggctggcctttgtacttag

SEQ ID NO: 16191 - DNA, 358 bp, Artificial
  Mutation in BnaA.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtaagacatcaagtggtacggcaagtacctcaacaaccctttgggacgcaccgtgatgttaacggttcagttcactctcggctggcctttgtacttag

SEQ ID NO: 16192 - DNA, 364 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagttacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16193 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagagtaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16194 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16195 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctccttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16196 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtaatagcccacgagtgcggccaccacgccttcagcgactaccagtggctggacgacaccgtcggcctcatcttccactccttcctcctcgtcccttacttctcctggaagtatcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggctggcctttgtacttag

SEQ ID NO: 16197 - DNA, 357 bp, Artificial
  Mutation in BnaA.FAD2.a introduced by TALE nuclease pair BnFAD2_T02
cctctcctccctcaccctctatcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16198 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctgaaaatcgacgccaccattccaacactggctccctcgagagagacgaagtgtttgtccccaagaagaaatccgacatcaagtggtacggcaagtacctcaacaaccctttgggacgcaccgtgatgttaacggttcagttcactctcggctggcctttgtacttag

SEQ ID NO: 16199 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcattagtacttag

SEQ ID NO: 16200 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaaccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16201 - DNA, 358 bp, Artificial
  Mutation in BnaA.FAD2.a introduced by TALE nuclease pair BnFAD2_T02
cctctcctccctcaccctctctcctacttcgcctggcctctctactgggcctgctagggctgcgtcctaaccggcgtctgggtcatagcccacgagtgcggccaccacgccttcagcgactaccagtggctggacgacaccgtcggcctcatcttccactccttcctcctcgtcccttacttctcctggaagtatcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 16202 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttttccccaagaagaagtcagacatcaagtggtacggcaagtacctcaacaaccctttgggacgcaccgtgatgttaacggttcagttcactctcggctggcctttgtacttag

SEQ ID NO: 16203 - DNA, 291 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 16204 - DNA, 406 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagcgcaatgacattcttgcaggtatcttcgagccagccacgatcgacagccatcgacgccgccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16205 - DNA, 358 bp, Artificial
  Mutation in BnaA.FAD2.a introduced by TALE nuclease pair BnFAD2_T02
cctctcctccctcaccctctctcctacttcgcatggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16206 - DNA, 356 bp, Artificial
  Mutation in BnaA.FAD2.a introduced by TALE nuclease pair BnFAD2_T02
cctctcctccctcaccctctatactacttcgcctggcctctctactgggcctgccaagggtgcgtcctaaccggcgtctgggtcatagcccacgagtgcggccaccacgccttcagcgaccaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtaccgcagcatccctttgaagcgcaccgtgatgttaaccgttcagttgactctcgtctggcctttgtgcttag

SEQ ID NO: 16207 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctgccctgagtacttag

SEQ ID NO: 16208 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 16209 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcatcgatgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggcctgtgtacttag

SEQ ID NO: 16210 - DNA, 355 bp, Artificial
  Mutation in BnaA.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaactctggctccctcgagagagacgaagtgtttgtccccaagaagaagtcagacatcaagtggtacggcaagtacctcaacaaccctttgggacgcaccgtgatgttaacggttcagttcactctcggctggcctttgcttag

SEQ ID NO: 16211 - DNA, 405 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaatgacggatggccttctgcttagtttgatgcctggcagtttatggcgggcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16212 - DNA, 330 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 16213 - DNA, 318 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggagagagacgaagtgtttgtccccaagaagaagtcagacatcaagtggtacggcaagtacctcaacaaccctttgggactcaccgtgatgttaacggttcagttcactctcggctggcctttatacttag

SEQ ID NO: 16214 - DNA, 359 bp, Artificial
  Mutation in BnaA.FAD2.a introduced by TALE nuclease pair BnFAD2_T02
cctctactccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16215 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggcttgacgacaccgtcggcctcatcttccactccttcctcctcgtcccttacttctccagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16216 - DNA, 312 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 16217 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccactagtggctggacgacgccgtgggcctcgtcttccactccttcctcctcgtcccttacttctcctggaagtatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16218 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16219 - DNA, 330 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 16220 - DNA, 432 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcgtcttccactccttcctcctcgtcccttacttctcctggaagtggaccgtctccagcgcctgcttgccaccgccattgctggcgatggccaccacctgctggggggtcaagttgagcgggtggtacggcaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16221 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcagcaaccctttgggacgcaccgtgatgttaacggttcagttcactctcggctggcctttgtacttag

SEQ ID NO: 16222 - DNA, 400 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaaccgcctctccccgcgcgttggcacgacaggtttcccgacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16223 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctgccctttgtacttag

SEQ ID NO: 16224 - DNA, 341 bp, Artificial
  Mutation in BnaA.FAD2.a introduced by TALE nuclease pair BnFAD2_T02
cctctcctccctcaccctctctcctacttcgcctggcatctctactgggcctgccaagggtgcgtcctacccggcctctgggtcatcgcccacgaatgcggccaccacgccttcagcgaccaccagtggctggacgacgccgtgggcctcgtcttccactccttcctcctcgtccagtcatcgacgccaccattccaacactggctccctcgagagagacgaagtgtttgtccccaagaagaagtcagacatcaagtggtacggcaagtacctcaacaaccctctggtgcgcaccgtaatgttaacggttcagttcactctcggctggcctttgtacttag

SEQ ID NO: 16225 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgcattcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggctggcctttgtacttag

SEQ ID NO: 16226 - DNA, 341 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtccagtcatcgacgccaccattccaacactggctccctcgagagagacgaagtgtttgtccccaagaagaagtcagacatcaagtggtacggcaagtacctcaataaccctttgggacgcaccgtgatgttaacggttcagttcactctcggctggcctttgtacttag

SEQ ID NO: 16227 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcagcatccctttggaacgcaccgtggggttaacggttcggttcacgctcggctggcctttgtgcttag

SEQ ID NO: 16228 - DNA, 433 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccgtctttgaacgttgtgatggccaccaatggcggcggctgttgcaggtgctgtgccaggcccacggcttggcagtcatcgacgccaccattccaacactggctccctcgagagagacgaagtgtttgtccccaagaagaaatccgacatcaagtggtacggaaagtacctcaacagcccgctaggacgcacggtgaggctaaccgtccagttcacgctcggctggcctgagtacttag

SEQ ID NO: 16229 - DNA, 383 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtctccagcgcctgcttgccaccgccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16230 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16231 - DNA, 347 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgcctcagcgactaccagtggcttgacgacaccgtcggtctcatcttccactccttcctcctcgtcccttacttctccttcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttggtgcttag

SEQ ID NO: 16232 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16233 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16234 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaacgggcctctgggtcatcgcccacgagtgcggccaccacgccttcagcgactaccagtggctggacgacaccgtcggcctcatcttccactccttcctcctcgtcccttacttctcctggacatcgacgccaccattccaacactggctccctcgagagagacgaagtgtttgtccccaagaagaagtcagacatcaagtggtacggcaagtacctcaacaaccctttggggcgcaccgtgatgttaacggttcagttcactctcggctggcctttgtacttag

SEQ ID NO: 16235 - DNA, 356 bp, Artificial
  Mutation in BnaA.FAD2.a introduced by TALE nuclease pair BnFAD2_T02
cctctcctccctcaccctctctcctacttctcctggcctctcgtctgcgcctgccagggctgcgtcctaaccggcgtctgggtcatagcctacgggtgcggccaccacgccttcagcgactaccagtggctggacgacaccgtcggcctcatcttccactccttcctcctcgtcccttacttctcctggaagtcatcgacgccaccattccaaccctggctccctcgagagagacgaagtgtttgtccccatgaagaagtcagacatcaagcggtaccgcaattaccccgacaccccttttgtgcgtaccgggctgttaaccgttcctttcactctcggctggcctttgtacttag

SEQ ID NO: 16236 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcatcccttacttctcctggaagtagtcatcgacgccaccattccaacactggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 16237 - DNA, 357 bp, Artificial
  Mutation in BnaA.FAD2.a introduced by TALE nuclease pair BnFAD2_T02
cctctcctccctcaccctctctcctacttcgcctggcctctctaccgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcagtctcggctggccttagtacttag

SEQ ID NO: 16238 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggctcagttcactctcggctggcctttgtacttag

SEQ ID NO: 16239 - DNA, 356 bp, Artificial
  Mutation in BnaA.FAD2.a introduced by TALE nuclease pair BnFAD2_T02
cctctcctccctcaccctctcccttacctcgcctggcccctcgactgttcctgccaggtctgcgtcctaaccggcgtctgggtcatagcccacgagtgcgtccaccacgccttcagcgactaccagtggctggacgacaccgtcggtctcatcttccactccttcctcctcgtcccttacttctcctggaagtcatcgacgccaccattccaacactggctccctcgagagagacgaagtgtttgtccccaagaagaagtcagccatcaagtggtccggctagtaccccaccaccccttttggacacaacgtaaagccacccgtcccgctccctctcggctggcctttgtacttag

SEQ ID NO: 16240 - DNA, 411 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacgcgtaccgctagccaggaagagtttgtagaaacgcaaaaaggccatccccagtcatcgacgccaccattccaacactggctccctcgagagagacgaagtgtttgtccccaagaagaagtcagacatcaagtggtacggcaagtacctcaacaacccgttgggtcgcaccgtgatgttaacggttcagttcactctcggctaacaatagtacgtag

SEQ ID NO: 16241 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacagccctgtgggacgcaccgtgatgttaacggttcatttcactctctgctggcctttgtacttag

SEQ ID NO: 16242 - DNA, 387 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaaggcgatggccaccacctgctccggggtcacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16243 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccgagaagaagtcagacatcaagtggtacggcaagtacctcaacaaccctttgggacgcaccgtgatgttaacggttcagttcactctcggctggcctttgtacttag

SEQ ID NO: 16244 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaatagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16245 - DNA, 340 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcagtcatcgacgccaccattccaacactggctccctcgagagagacgaagtgtttgtccccaagaagaagtcagatatcaagtggtacggcaagtacctcaacaaccctgtgggacgcaccgtgatgttaacggttcagttcactctcggctggcctttgtacttag

SEQ ID NO: 16246 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaatgggcctctgggtcatcgcccacgaatgcggccaccacgccttcagcgaccaccagtggctggacgacgccgtgggcctcgtcttccactccttcctcctcgtcccttacttctcctggaagggccatcgacgccaccattccaacaccggatccctcgagagggatgaagtgttcgtccccaagaagaagtcagacatcaagtggtacggcaagtacctcaacaaccctttgggacgcaccgtgattttaacggttcagttcactctcggctggcctttgtacttag

SEQ ID NO: 16247 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaggtcatctacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16248 - DNA, 358 bp, Artificial
  Mutation in BnaA.FAD2.a introduced by TALE nuclease pair BnFAD2_T02
cctctcctccctcaccctctctcctacttcgcctggcatctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcgtctggcctttgtactcag

SEQ ID NO: 16249 - DNA, 357 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcaaacatcaagtggttcggcaattacctcaacaacccgttggaacgcaccgtgaggttaacttttcagttcactctcggctggcctgtgtacttag

SEQ ID NO: 16250 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctgaaaatcgacgccaccattccaacactggctccctcgagagagacgaagtgtttgtccccaagaagaagtcagacatcaagtggtacggcaagtacctcaacaaccctgtgggacgcaccgtgatgttaaccgttcagttcactctcggctggcctttgtacttag

SEQ ID NO: 16251 - DNA, 413 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacaatggccaccacctgctggggtgtcaagccgtgggcctggcacagcaccggcagtcatcgacgccaccattccaacactggctccctcgagagagacgaagtgtttgtccacaagaagaaatccgacatcaagtggtacggaaagtacctcaacaacccgctaggacgcacggtgatgctaaccgtccagttcacgctcggctggcctttgtacttag

SEQ ID NO: 16252 - DNA, 346 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggcgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 16253 - DNA, 348 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttcttcatcgacgccaccattccaacactggctccctcgagagagacgaagtgtttgtccccaagaagaagtcagacatcaagtggtacggcaagtacctcaacagccctttgggacgcgccgtgaggttaacggttcaggtcactctcggctggcctttgtacttag

SEQ ID NO: 16254 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacgtcatcgacgccaccattccaacactggctccctcgagagagacgaagtgtttgtccccaagaagaagtcagacatcaagtggtacggcaagtacctcaacacccctgtgggacgcaccgtgatgttaaccgttcagttcactctcggctggcctttgtacttag

SEQ ID NO: 16255 - DNA, 353 bp, Artificial
  Mutation in BnaA.FAD2.a introduced by TALE nuclease pair BnFAD2_T02
cctctcctccctcaccctctctcctacttcgcctggcctctctactaggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16256 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctcagtcatcgacgccaccattccaacactggctccctcgagagagacgaagtgtttgtccccaagaagaagtcagacatcaagtggtacggcaagtacctcaacaaccctttgggacgctccgtgatgttaaccgtccagttcacgctcggctggcctttgtacttag

SEQ ID NO: 16257 - DNA, 353 bp, Artificial
  Mutation in BnaA.FAD2.a introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcggctaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtaccttaacaaccctttgggacgcaccgtgatgttaacggtacagttcactctcggctggcctttgtactta

SEQ ID NO: 16258 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 16259 - DNA, 365 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggccggacgacaccgtcggcctcatcttccactccttcctcctcgtcccttacttctcctggaagtaactacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 16260 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcaaacatcgagtggtacggcaagtacctcaacaaccctttgggacgcaccgggaggttaacggttcagttcactctcggctggccttagtacttag

SEQ ID NO: 16261 - DNA, 443 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtaggcgatggccaccacctgctccggggtcaagccgtgggcctggcacagcaccggcaacagcgcctgcaccgtctccagcgcctagtcatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggctggcctttgtacttag

SEQ ID NO: 16262 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaacccttggggacgcaccgtgatgtgaacggttcagttcactctcggctggcctttgtacttag

SEQ ID NO: 16263 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccgttgggacgcaccgtgaggttaacggttcagttcactctcggctggcctttgtacttag

SEQ ID NO: 16264 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaagcatcgacgccaccattccaacactggctccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 16265 - DNA, 332 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaagtggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 16266 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcatcaaccctttgggacgcaccgtgatgttaactgttgagtgcactctcggctggcctttggacttag

SEQ ID NO: 16267 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtaagtcgtcgacgccaccattccaacactggctccctcgggagagacgaagtgtttgtccccaagaagaagtcagacatcaagtggtacggcaagtacctcaacaaccctttgggacgcaccgggatgttaacggttcagtgcactctcggctggccttggtacttag

SEQ ID NO: 16268 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttgcttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16269 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16270 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacgccaagtacctcaacaaccctttgggacgcaccgtgaagttaacggttcagttcactctcggctggcctttgtacttag

SEQ ID NO: 16271 - DNA, 355 bp, Artificial
  Mutation in BnaA.FAD2.a introduced by TALE nuclease pair BnFAD2_T02
cctctctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16272 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtaagacatcaagtggtacggcaagtacctcaacaaccctttgggacgcaccgtgatgttaacggttcagttcactctcggctggcctttgtacttag

SEQ ID NO: 16273 - DNA, 294 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccatgagtgcggccaccacgccttcagcgactaccagtggctggacgacaccgtcggcctcatcttccactccttcctccttgtcaagtgtttgtccccaagaagaagtcagacatcaagtggtacggcaagtacctcaacaaccctttgggacgcaccgtgaggttaacggttcagttcactctcggctggcctttgtacttag

SEQ ID NO: 16274 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcgaccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16275 - DNA, 356 bp, Artificial
  Mutation in BnaA.FAD2.a introduced by TALE nuclease pair BnFAD2_T02
cctctcctccatcaccctctctcctacttcgcctggccactctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgtgaaccgttcagttcactctcggctgccctgagtacttag

SEQ ID NO: 16276 - DNA, 348 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttcttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttcgtacttag

SEQ ID NO: 16277 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16278 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaagtagtcatcgacgccaccattccaacactggctccctcgagagagacgaagtgtttgtccacaagaagaagtcagacatcaagtggtacggcaagtacctcaacaaccctttgggacgcaccgtgatgttaacggttcagttcactctcggctggcctttgtacttag

SEQ ID NO: 16279 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtttgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16280 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtccctttcttctcctggaagccatcgacgccaccattccaacactggctccctcgagagagacgaagtgtttgcccccaagaagaagtcagacatcaagtggtacggcaagtacctcaacaaccctttgggacgcaccgtgatgttaacggttcagttcactctcggctggcctttgtacttag

SEQ ID NO: 16281 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 16282 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtgccatcgacgccaccattccaacaccggatccctcgagagggatgaagtgttcgtccccaagaagaagtcagacatcaagtggtacggcaagtacctcaacaaccctttggggcgcaccgtgatgttaacggttcagttcactctcggctggcctttgtacttag

SEQ ID NO: 16283 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggccatagcccacgagtgcggccaccacgccttcagcgactaccagtggctggacgacaccgtcggcctcatcttccactccttcctcctcgtcccttacttctcctggaagagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 16284 - DNA, 415 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtacggccaccacgccttcagcgactaccagtggctggacgacaccgtcggcctcatcttccactccttcctcctcgtcccttacttctcctggaagactgggcctttcgttttatctgggtccagcggctgttgccggtgctgtgccaggcccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 16285 - DNA, 357 bp, Artificial
  Mutation in BnaA.FAD2.a introduced by TALE nuclease pair BnFAD2_T02
cctctcctccctcaccctctaccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacagttcaatgcactctcggctggcctttgtacttag

SEQ ID NO: 16286 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 16287 - DNA, 421 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcctcttccactccttcctcctcgtcccttacttctcctggaagtaaaaccaccgctaccagcggtggtttgtttgccggatcaagagctataactacggctacactagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16288 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagttcggccaccacgccttcagcgactaccagtggctggacgacaccgtcggcctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 16289 - DNA, 383 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgcctcagcgactaccaggggccggacgccaccgtcggtctcatcttcccctccttcctcctcgtcccttacttctcctgcaatggcggtggcaagcaggcgctggagacggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16290 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaagttacagtcatcgacgccaccattccaacactggctccctcgagagagacgaagtgtttgtccccaagaagaagtcagacatcaagtggtacggcaagttccgcaggaaccgttagaggcgcaccgtgatgttaaccgttcagttcactctcggctggcctttgtacttag

SEQ ID NO: 16291 - DNA, 312 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctgggctggcctttgtacttag

SEQ ID NO: 16292 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 16293 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacgccgtgggcctcgtcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16294 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatgtcatcgacgccgccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16295 - DNA, 362 bp, Artificial
  Mutation in BnaA.FAD2.a introduced by TALE nuclease pair BnFAD2_T02
cctctcctccctcaccctctcacttacctcgcctggcacatttactgggcctgccaaggctgcgtcctaaccggcgtctgggtcatagcccacgagtgcggccaccacgacttcagcgactaccagtggctggacgacaccgtcggcctcatcttccactccttcctcctcgtcccttacttctccgggaagttacagtcatcgacgccaccattccaacactggctccctcgagagagacgaagtgtttgtccccaagaagaagtccgacatcaagtggtacggcaagtgcctctacaaccctttggaacgcaccgtgatgttaacggttcagttcactttccgcttccctttgtacttag

SEQ ID NO: 16296 - DNA, 346 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagaccacgagtgcggccaccacgccttcagcgactaccagtggctggacgacaccgtcggcctcatcttccactccttcctcctcgtcccttacttctcctggagccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16297 - DNA, 294 bp, Artificial
  Mutation in BnaA.FAD2.a introduced by TALE nuclease pair BnFAD2_T02
cctctcctccctcaccctctctcctacttcgcctgtcctctctactgcgcctgccaagggtgcgtcctaaccggcgtctgggtcatagcccacgagtgcggccaccacgccttcagcgactaccagtggctggacgacaccgtcggcctcatcttccactccttcctccttgtcaagtgtttgtccccaagaagaagtcagacatcaagtggtacggcaagtacctcaacaaccctttgggacgcaccgtgatgttaacagttcagttcactctcggctggcctttgtacttag

SEQ ID NO: 16298 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 16299 - DNA, 312 bp, Artificial
  Mutation in BnaA.FAD2.a introduced by TALE nuclease pair BnFAD2_T02
cctctcctccctcaccctctctcctacttcgcctggcctctctactgggcctgccaggactgcgtcctaaccggcgtctgggtcatagcccacgagtgcggccaccacgccttcagcgactaccagtggctggacgacaccgtcggcctcatcgacgccaccattccaacactggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 16300 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctccagtagtcatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16301 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 16302 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16303 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctagtcatcgacgccaccattccaacactggctccctcgagagagacgaagtgtttgtccccaagaagaagtcagacatcaagtggtacggcaagtaccgcaacaaccctttgggacgcaccgtgatgttaacggttcagttcgctctcggctggcctgtgtacttag

SEQ ID NO: 16304 - DNA, 357 bp, Artificial
  Mutation in BnaA.FAD2.a introduced by TALE nuclease pair BnFAD2_T02
cctctcctccctcaccctctctcctacttcgcctggcatctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaaatccgacatcaagtggtacggaaattacctcaacaacccgctaggacgcacggggatgcttgccgtcgatttcactctcggcttgccttcgtacttag

SEQ ID NO: 16305 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcctcttccactccttcctcctcgtcccttacttctcctggaatcatcgacgtcaccttcccaacactggctccctcgagagagacgaagtgtttgtccccaagaagccgtcagacatcaagtggtccctcaattacctcaccacgccgcgaggacgtacggtgatgctaaccgtccctttcccgctcggctggcctttgtacttag

SEQ ID NO: 16306 - DNA, 294 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctccttgtcaagtgtttgtccccaagaagaagtcagacatcaagtggtacggcaagtacctcaacaaccctttgggacgcaccgtgatgttaacggttcagttcactctcggctggcctgagtacttag

SEQ ID NO: 16307 - DNA, 346 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggctggacgacaccgtcggcctcatcttccactccttcctcctcgtcccgtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16308 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgacaaccagtggctggacgacgccgtgggcctcgtcttccactccttcctcctcgtcccttacttctcctggaaagccatcgacgccaccattccaacaccggatccctcgagagagacgaagtgtttgtccccaagaagaagtcagacatcaagtggtacggcaagtacctaaacaaccctttgggacgcaccgtgatgttaacggttcagttcactctcggctggcctgtgtacttag

SEQ ID NO: 16309 - DNA, 363 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttat

SEQ ID NO: 16310 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacatccctttgggacgcaccgtgatgttaacggttcagttcgctctcggctggcctttgtacttag

SEQ ID NO: 16311 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggactcatcgacgccaccattccaacactggctccctcgagagagacgaagtgtttgtccccaagaagaagtcagacaccaagtggtacggcaagtacctcaacagccccttgggacgcaccgtgatgttaacggttcagtgcactctcggctggccttcgtacttag

SEQ ID NO: 16312 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagcatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggctggcctttgtacttag

SEQ ID NO: 16313 - DNA, 365 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttcctcctcgtcccttacttctcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggctggcctttgtacttag

SEQ ID NO: 16314 - DNA, 441 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtgtgccaggcccacggcttgaccccccagcaggtggtggccatcgccggccagcaacgtcggttcgagatggcgctcgatgacggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16315 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 16316 - DNA, 355 bp, Artificial
  Mutation in BnaA.FAD2.a introduced by TALE nuclease pair BnFAD2_T02
cctctcctccctcaccctctctcctacttcgcctcgcctccctaatgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcgtgtaccccaacagacctgtggaagggactgtgatgcgacccgtacagtttagtctcggctggcctttgtacttag

SEQ ID NO: 16317 - DNA, 348 bp, Artificial
  Mutation in BnaA.FAD2.a introduced by TALE nuclease pair BnFAD2_T02
cctctcctccctcaccctctctgctacttcgcctggcctctctactgggcctgccagggctgcgtcctaaccggcgtctgggtcatagaccacgagtgcggccaccacgccttcagcgactaccagtggcttgacgaaaccgtcggtctcatcttccactccttcctcctcgtcccttacttctccatcgacgccaccattccaagaccggcttcctcgagagagacgaattgtttgtccccaagaagaagtcagacaccaagtggtacggcaagtaccacaacaacccttcgggtcgctcgggggtgctagccgtccagtccacgctcggctggcctttgtactaag

SEQ ID NO: 16318 - DNA, 422 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacggcttgaccccggagcaggtggtggccatcgccagccacgatggcggcaagcaggcgctggagtcatcgacgcaaccattccaacactggctcccgcgagagagacgaagtgtttgtccccaataagaagtcagacatccagtggtgcggcaagtacctcagcaagcatttgggacgccccgtgatgttaacggttccgttccctctcggctggcctttgtacttag

SEQ ID NO: 16319 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttggtacttag

SEQ ID NO: 16320 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagatgaagtgtttgtccccaagaagaagtcagacatcaagtggtacggcaagtacctcaacaaccctttgggacgcaccgtgatgtgaacggttcagttcactctcggctggcctttgtacttag

SEQ ID NO: 16321 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatctaccactccttcctcctcgtcccttacttctcctggaaagccatcgacgccaccattccaacaccggatccctcgagagggatgaagtgttcgtccccaagaagaagtcagacatcaagtggtacggcaagtacctcaacaacccgttgggacgcaccgtgatgttaacggttcagttcactctcggctggccttagtacttag

SEQ ID NO: 16322 - DNA, 357 bp, Artificial
  Mutation in BnaA.FAD2.a introduced by TALE nuclease pair BnFAD2_T02
cctctcctccctcactctctctcctacttcgcctggcctctctactgggcctcccatggctacgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcagcaagcgtttgggacgcaccgtgatcttaacggctcagttcactctcggctggcctttgtacttag

SEQ ID NO: 16323 - DNA, 294 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctccttgtcaagtgtttgtccccaagaagaagtcagacatcaagtggtacggcaagtacctcaacaacccgctaggacgcacggtgatgctaaccggccagttcacgctcggctgtcctttgtacttag

SEQ ID NO: 16324 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16325 - DNA, 367 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacacacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcatttgtacttag

SEQ ID NO: 16326 - DNA, 348 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcctacgagtgcggccaccacgccttcagcgactaccagtggctggacgacaccgtcggcctcatcttccactccttcctcctcgtcccttacttctccatcgacgccaccattccaacactggctccctcgagagagacgaagtgtttgtccccaagaagaagtcagacatcaagtggtacggcaagtacctcaacaaccctttgggacgcaccgtgatgttaacggttcatttcactctcggctggcctttgtacttag

SEQ ID NO: 16327 - DNA, 335 bp, Artificial
  Mutation in BnaA.FAD2.a introduced by TALE nuclease pair BnFAD2_T02
cctctcctccctcaccctctcccttacctcgcctggccactctactgggcctgccaaggctgcgtcctaaccggcgtctgggtcatagcccacgagtgcggccaccacgccttcagcgactaccagtggctggacgacaccgtcggcctcatcttccactccttcctcctcgtcccttactcaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16328 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtatcgacgccaccattccaacactggctccctcgagagagacgaagtgtttgtccccaagaagaagtcagacaacaagtggtacggcaagtacctcaacaacccgttgggacgcaccgtgatgttaacggttcagttcactctcggctggccttgtacttag

SEQ ID NO: 16329 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 16330 - DNA, 413 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtggcacagcaccggcaacagcgcctgcaccgtctccagcgcctgcttgccaccaatatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16331 - DNA, 342 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaaattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactttag

SEQ ID NO: 16332 - DNA, 340 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcttccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 16333 - DNA, 341 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtccagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 16334 - DNA, 358 bp, Artificial
  Mutation in BnaA.FAD2.a introduced by TALE nuclease pair BnFAD2_T02
cctctcctccctcaccctctctcctacttcgcctggcccctctactgggcctgccagggctgcgtcctaaccggcgtctgggtcatagcccacgagtgcggccaccacgccttcagcgactaccagtggcttgacgacaccgtcggcctcatcttccactccttcctcctcgtcccttacttctcctggaagtatcatcgacgccaccattccaacactggctccctcgagagagacgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 16335 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcttcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16336 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaacagtcatcgacgccaccattccaacactggctccctcgagagagacgaagtgtttgtccccaagaagaagtcagacatcaagtggtacggcaagtacctcaacaaccctttggaacgcaccgtgatgttaacgtttcagttgactctcggctggcctttgtacttag

SEQ ID NO: 16337 - DNA, 405 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatgttgccaccgccattgctggcgatggccaccacctgctggggggtcaagccatcgacgccaccattccaacactggctccctcgagagagacgaagtgtttgtccccatgaagaagtcagacatcaagtggtacggcaagtacctcaacaacccttggggacgcaccgtgatgttaacggttcagttcactctcggctggcctttgtacttag

SEQ ID NO: 16338 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgtcctttgtacttag

SEQ ID NO: 16339 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctgtgggacgcaccgtgaggtgaacggttcagttcactctcggctgccctttgtacttag

SEQ ID NO: 16340 - DNA, 400 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtctccaaattgcagttcgcgcttagctggataacgccacggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16341 - DNA, 394 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggacgccattgctggcgatggccaccacctgctggggggtcagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 16342 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaacccgctaggacgcaccgtgatgttaacggttcagttcactctcggctggcctttgtacttag

SEQ ID NO: 16343 - DNA, 347 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctccacgacgccaccattccaacactggctccctcgagagagacgaagtgtttgtccccaagaagaagtcagacatcaagtggtacggaaagtacctcaacatccctttgggacgcaccgtgatgttaacggttcagttccctctcggctggccttagtacttag

SEQ ID NO: 16344 - DNA, 417 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtccacgatcacgccgtagtcgatgggggagcccaatcctgttgccggtcttgcgatgattatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16345 - DNA, 292 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16346 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttgtcatcgacgccgccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtgcttag

SEQ ID NO: 16347 - DNA, 363 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacgccgtgggcctcgtcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 16348 - DNA, 356 bp, Artificial
  Mutation in BnaA.FAD2.a introduced by TALE nuclease pair BnFAD2_T02
cctctcctccctcaccctctctcctacttcgcctggcatctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtaaggcacgccaccattccaacactggctccctcgagagagacgaagtgtttgtccccaagaagaagtcagacatcaagtggtacggcaagtacctcaacaaccctttgggacgcgccgtgatgttaacggttcagttcgctctcggctggcctttgtacgtag

SEQ ID NO: 16349 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagtgctctctcggctggcctttgtacttag

SEQ ID NO: 16350 - DNA, 381 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaacagcaccggcaacagccgctggacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16351 - DNA, 356 bp, Artificial
  Mutation in BnaA.FAD2.a introduced by TALE nuclease pair BnFAD2_T02
cctctcctccctcaccctctcccttacctcgcctagcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 16352 - DNA, 392 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgaatgcggccaccacgccttcagcgaccaccagtggctggacgacgccgtgggcctcgtcttccactccttcctcctcgtcccttacttctcctggaagtgggcctggcacagcaccggcaagcaggcgctggagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 16353 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaacccgctaggacgcacggggatgctaaccgtccagttcacgctcggctggcctttgtacttag

SEQ ID NO: 16354 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcgtcttgccgttgtacttag

SEQ ID NO: 16355 - DNA, 370 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaagaaaaatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16356 - DNA, 350 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctcatcgacgccaccattccaacactggctccctcgagagagacgaagtgtttgtccccaagaagaagtcagacatcaagttgtacggcaagtaccgcaacaaccctttgggacgcaccgtgatgttaacggttcatttcactctcggctggcctgtgtacttag

SEQ ID NO: 16357 - DNA, 345 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctacccggcgtctgggtcatagcccacgagtgcggccaccacgccttcagcgactaccagtggctggccgacaccgtcggcctcatcttccactccttcctcctcttcccttacttcatcgacgcctccattccaacactggctccctcgagagagacgaagtgtttgtccccaagaagaagtcagacatcaagtggtacggcaagtacctcaacaaccctttgggtcgcaccgtgatgttaacggttcagttgactcgcggctggcctttgtacttag

SEQ ID NO: 16358 - DNA, 358 bp, Artificial
  Mutation in BnaA.FAD2.a introduced by TALE nuclease pair BnFAD2_T02
cctctcctccctcacctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16359 - DNA, 352 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggcatcgacgccaccattccaacactggctccctcgagagagacgaagtgtttgtccccaagaagaagtcagacatcaagtggtacagcaagtacctcaacaaccctttgggacgcaccgtgatgttaacggttcagttcactctcggctggcctttgtacttag

SEQ ID NO: 16360 - DNA, 326 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggatccatcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 16361 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16362 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagtcatcgacgccaccattccaacactggctccctcgagagagacgaagtgtttgtccctaagaagaagtcagacatcaagtggtacggcaagtacctcaacaaccctttgggacgcaccgtgatgttaacggttcagttcactctcggctggcctttgtacttag

SEQ ID NO: 16363 - DNA, 355 bp, Artificial
  Mutation in BnaA.FAD2.a introduced by TALE nuclease pair BnFAD2_T02
cctctcctccctcaccctctcccttacctcgcctggcacctctactgggcctgccaaggctgcgtcctaacgggcctctgggtcatcgcccacgaatgcggctaccacgccttcagcgaccaccagtggctggacgacgccgtgggcctcgtcttccactccttcctcctcgtcccttacttctcctggaagtatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16364 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacacccctttgggacgcaccgtgatgttaacggttcagttcactctcggctggcctttgtacttag

SEQ ID NO: 16365 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16366 - DNA, 354 bp, Artificial
  Mutation in BnaA.FAD2.a introduced by TALE nuclease pair BnFAD2_T02
cctctcctccctcaccctctctcctacttctcctggcctctctactgtgcctgccagggctgcgtcctaaccggcgtctgggtcatagcccacgagtgcggccaccacgccgtcagcgactaccagtggctggacgacaccgtcggcctcatcttccactccttcctcctcgtcccttacttctcctggaatatcgacgccaccattccaacactggctccctcgagagagacgaagtgtttgtccccaagaagaagtcagacatcaagtggccccgcaagtaccccaccacgccttagggacgcaaggtgatgtttaccgttccgttccctctcggctggcctttgtacttag

SEQ ID NO: 16367 - DNA, 358 bp, Artificial
  Mutation in BnaA.FAD2.a introduced by TALE nuclease pair BnFAD2_T02
cctctcctccctcaccctctctcctacttcgcctcgcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16368 - DNA, 340 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcccaccattccaacaccggatccctcgatagggacgaagtgttcgtccccaagaagaaatccgacatcaagtggtacggcaagtacctcaacaacccgctaggacgcacggtgatgctaaccgtccagttcaagctcggctggcctttgtacttag

SEQ ID NO: 16369 - DNA, 339 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctccaccattccaacactggctccctcgagagagacgaagtgtttgtccccaagaagaagtcagacatcaagtggtacggcaagtacctcaacaaccctttgggacgcaccgtgatgttaacggttcagttcactctcggctgccctttgtacttag

SEQ ID NO: 16370 - DNA, 335 bp, Artificial
  Mutation in BnaA.FAD2.a introduced by TALE nuclease pair BnFAD2_T02
cctctcctccctcaccctctctcctacttcgcctggcctctctactgagcctgccagggctgcgtcctaaccggcgtctgggtcatagcccacgagtgcggccaccacgccttcagcgactaccagtggctggacgacaccgtcggcctcatcttccactccttcctcctcgtcccttactcaccattccaacactggctccctcgagagagacgaagtgtttgtccccaagaagaagtaagacatcaagtggtacggcaagtacctcaacaaccctttgggacgcaccgtgatgttaacggttcagttcactctcggctggcctttgtacttag

SEQ ID NO: 16371 - DNA, 379 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggctccgcccccctgacgagcatcacagtcatcgacgccaccattccaacactggctccctcgagagagacgaagtgtttgtccccaagaagaaggcagacatcaagtggtacggcaagtacctcaacaacccttttggacgcaccgtgatgttaacggttcagttcactctcggctggcctttgtacttag

SEQ ID NO: 16372 - DNA, 321 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16373 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaattacctcaacaaccctttgggacgcaccgtgatgttaactgttcagttcactctcggctggcctttgtacttag

SEQ ID NO: 16374 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttggtacttag

SEQ ID NO: 16375 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaagtacaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16376 - DNA, 323 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccgctcgccgcagccgaacgaccgagaagaagtcagacatcaagtggtacggcaagtacctcaacaaccctttgggacgcaccgtgatgttaacggttcagttcactctcggctggccgttgtacttag

SEQ ID NO: 16377 - DNA, 356 bp, Artificial
  Mutation in BnaA.FAD2.a introduced by TALE nuclease pair BnFAD2_T02
cctctcctccctcaccctctctcctacttcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16378 - DNA, 436 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaagcggtggtttttttgtttgcaagcagcagattacgcgcagaaaaaaaggatctcaagtgaccttaggcgacttttgaacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16379 - DNA, 350 bp, Artificial
  Mutation in BnaA.FAD2.a introduced by TALE nuclease pair BnFAD2_T02
cctctcctccctcacccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttttacttag

SEQ ID NO: 16380 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16381 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtcggcctcatcttccactccttcctcctcgtcccttacttctccttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16382 - DNA, 339 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctccaccatttcaacactggcttcctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16383 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcatttcactctcggctggcctgtgtacttag

SEQ ID NO: 16384 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggccttggtacttag

SEQ ID NO: 16385 - DNA, 412 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcggtggacctctcaactctcccgccaccgtgagcaaggcctccagagcgcgtgcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16386 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttgtacttag

SEQ ID NO: 16387 - DNA, 388 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtacagcaacgtcggttcgagatggcgctcgaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactta

SEQ ID NO: 16388 - DNA, 357 bp, Artificial
  Mutation in BnaA.FAD2.a introduced by TALE nuclease pair BnFAD2_T02
cctctcctccctcaccctctctcctacttcgcctggcctctctaatgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaaccttccagttcacgctcggctggcctttgtacttag

SEQ ID NO: 16389 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgctgccaccacgccttcagcgactaccagtggctggacgacaccgtcggcctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacagcccttggggacgcaccgtgatgttaacagttcagttcactctcggctggcctttgtacttag

SEQ ID NO: 16390 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactcctttctcctcgtcccttactcctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16391 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggctggcctttgtacttag

SEQ ID NO: 16392 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 16393 - DNA, 332 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcctcttccactccttcctcctcgtcccttacttctcctggaagtggctccctcgagagagacgaagtgtttgtccccaagaagaagtcagacatcaagtggtacggcaagtacctcaacacccctctggaacgcaccgtgaggttaacggttcatttcactctcggctggcatgagcacttag

SEQ ID NO: 16394 - DNA, 344 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggacaccattccaacactggctccctcgagagagacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 16395 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtactaaccggcgtctgggtcatagcccacgagtgcggccaccacgccttcagcgaccaccagtggctggacgacgccgtgggcctcgtcttccactccttcctcctcgtccattacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16396 - DNA, 356 bp, Artificial
  Mutation in BnaA.FAD2.a introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgagtacttag

SEQ ID NO: 16397 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaatgtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 16398 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccatcgacgccaccattccaacaccggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 16399 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgtgacgcaccgtgatgttaacggttcagttcactctcggctggcctttgtacttag

SEQ ID NO: 16400 - DNA, 336 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 16401 - DNA, 339 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggccccatcttccactccttcctcctcgtcccttacttctccaccatttcaacactggcttcctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 16402 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctccagtagtcatcgacgccaccattccaacactggctccctcgagagagacgaagtgtttgtccccaagaagaagtcagacatcaagtggtacggcaagtacctcaacaaccctttgggacacaccgtgatgttaacggttcagttcactctcggctggcctttgtacttag

SEQ ID NO: 16403 - DNA, 356 bp, Artificial
  Mutation in BnaA.FAD2.a introduced by TALE nuclease pair BnFAD2_T02
cctctcctccctcaccctctctcctacttcgccttgcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagccatcgacgccaccattccaacaccggatccctcgagagggatgaagtgttcgtccccaagaagaaatccggcatcaagtggtacggcaagtacctcaacaaccctttgggacgcaccgtgatgttaacggttcagttcactctcggccggcctttgtacttag

SEQ ID NO: 16404 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtcggcctcctcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 16405 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggaaagtacctcaacaacccgctaggacgcacggtgaggctaaccgtccagtgcacgctcggctggcctttgtacttag

SEQ ID NO: 16406 - DNA, 348 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttcttcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 16407 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 16408 - DNA, 435 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccaagccccccagcaggcgagggccaccacctgctgaggggtcaagccgtgggcctggcacagcaccgccaacagccgctggagacgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16409 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacactttgggacgcaccgtgatgttaacggttcagttcactctcggctggccgttgtacttag

SEQ ID NO: 16410 - DNA, 346 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcctcttccactccttcctcctcgtcccttacttctcctggagcaggcaatccaacactggctccctcgagagagacgaagtgtttgtccccaagaagaaatccgacatcaagtggtacggaaagtacctcaacagcccgctaggacgcacggtgatgctaaccgtccagtgtacgctcggctggccgtggtacttag

SEQ ID NO: 16411 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagccatcaagtggtacggcaagtacctcaacacccctttgggacgcaccgtgatgttatcggttgagttcactctcggctggcctttgtacttag

SEQ ID NO: 16412 - DNA, 356 bp, Artificial
  Mutation in BnaA.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16413 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 16414 - DNA, 335 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttactcaccattccaacactggctccctcgagagagacgaagtgtttgtccccaagaagaagtcagacatcaagtggtactgcaagtacctcaacaaccctttgggacgcaccgtgatgttaacggttcagttcactctcggctggcctttgtacttag

SEQ ID NO: 16415 - DNA, 363 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16416 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagggatgaagtgtttgtccccaagaagaagtcagacatcaagtggtacggcaattacctcaacaaccctttgggacgcaccgtgatgttaacggttcagttcactctcggctggcctttgtacttag

SEQ ID NO: 16417 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggatcatcgacgccaccattccaacactggctccccgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16418 - DNA, 357 bp, Artificial
  Mutation in BnaA.FAD2.a introduced by TALE nuclease pair BnFAD2_T02
cctctcctccctcaccctctctcctacttcgcctggcacctctactgggcctgccagggctgcgtcctaaccggcgtctgggtcatagcccacgagtgcggccaccacgccgtcagcgactaccagtggctggacgacaccgtcggcctcatcttccactccttcctcctcgtcccttacttctcctggaaggtcatcgacgccaccattccaacactggctccctcgagagagacgaagtgttcgtccccaagaagaaatccgacatcaagtggtacggaaagtgcctcagcagcccgctaggacgcacggtgatgctagccgtccagttcacgctcggctggcctttgttcttag

SEQ ID NO: 16419 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaacagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacatccctttggaacgcaccgtgaggtaaacggttcagttcacgctcggctggccttagtacttag

SEQ ID NO: 16420 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacgccgtgggcctcatcttccactacttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16421 - DNA, 357 bp, Artificial
  Mutation in BnaA.FAD2.a introduced by TALE nuclease pair BnFAD2_T02
cctctcctccctcaccctctcccttacctcgcctggcccctctactgtgcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16422 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgataacggttcagttcactctcggctggcctttgtacttag

SEQ ID NO: 16423 - DNA, 354 bp, Artificial
  Mutation in BnaA.FAD2.a introduced by TALE nuclease pair BnFAD2_T02
cctctcctccctcaccctctctcctacttcgcctggcctctctactgggcctaccaagggtgcgtcctaaccggcgtctgggtcatagcccacgagtgcggccaccacgccttcagcgactaccagtggctggacgacaccgtcggcctcatcttccactccttcctcctcgtcccttacttctcctcagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 16424 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 16425 - DNA, 354 bp, Artificial
  Mutation in BnaA.FAD2.a introduced by TALE nuclease pair BnFAD2_T02
cctctcctccctcaccctctcccttacctcgcctgacccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 16426 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaactcatcgacgccaccattccaacaccggatccctcgagagggatgaagcgtttgtccccaagaagaagccagacatcaagtggtacggcaagtgcctcaacaaccctttggggcgcaccgtgatgttaacgtttcagttccctctcggctggcctgagtacttag

SEQ ID NO: 16427 - DNA, 310 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgtctttgtccccaagaagaagtcagacatcaagtggtacggcaagtacctcaacaaccctttgggacgcaccgtgatgttaacggttcagttcactctcggctggcctttgtactta

SEQ ID NO: 16428 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccagtcatcgacgccaccattccaacactggctccctcgagagagacgaagtgtttgtccccaagaagaagtcagacatcaagtggtacggcaagtacctcaacaaacgtttgggacgcaccgtgaagttaacggttcagttcactctcggctggcatttgtacttag

SEQ ID NO: 16429 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtgcttag

SEQ ID NO: 16430 - DNA, 469 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagccagcaataatggtggcaagcaggcgctggagacggtccagcggctgttgccggtgctgtgccaggcccacggcttgaccccccagcaggtggtggccatcgccattgaacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 16431 - DNA, 409 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagcaacagccgctggaccgtctccagcgcctgcttgccgccatcgtggctggcgagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16432 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctgtgggacgcaccgtgattttaacggttcagttcactctcggctggccttggtacttag

SEQ ID NO: 16433 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 16434 - DNA, 357 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 16435 - DNA, 332 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16436 - DNA, 356 bp, Artificial
  Mutation in BnaA.FAD2.a introduced by TALE nuclease pair BnFAD2_T02
cctctcctccctcaccctctcccttacctcgcctggccactctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttggtacgcaccgtgatgttaacgggtcagttcgctctcggctggcctcggtacttag

SEQ ID NO: 16437 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 16438 - DNA, 318 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagacgaagtgtttgtccccaagaagaagtcagacatcaagtggtacggcaagtacctcaacaaccctttgggacgcaccgtgatgttaacggttcacttcactctcggctggcctttgtacttag

SEQ ID NO: 16439 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 16440 - DNA, 312 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcgacgccaccattccaacaccggatccctcgagagggatgaagtgttcgtccccaagaagaaatccgacatcaagtggtacggcaagtacctcaacaacccttggggacgcaccgtgatgttaacggttcagttcactctcggctggcctttgtacttag

SEQ ID NO: 16441 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgctagtacgcacggtgatgctaaccgtccagttcacgctcggctggcctttgtacttag

SEQ ID NO: 16442 - DNA, 345 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 16443 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagttatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16444 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcgacgccaccattccaacactggctccctcgcgagagacgaagtgtttgtccccaagaagaagtcagacatcaagtggtacggcaagtacctcaacaaccctttgggccgcaccgtgattttaacggttcagttcacgctcggctggcctctgtacttag

SEQ ID NO: 16445 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcagcaaccctttgggacgcaccgtgatgttaacggttcagttcactctcggctggcctgtgtacttag

SEQ ID NO: 16446 - DNA, 408 bp, Artificial
  Mutation in BnaA.FAD2.a introduced by TALE nuclease pair BnFAD2_T02
cctctcctccctcaccctctctcctacttcgcctggcctctctactgcgcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagctgagcggggcacccgtcactgcattgcgccatgcatgcactgcctccaaagtcatcgacgccaccattccaacactggctccctcgagagagacgaagtgtttgtccccaagaataagtcagccatcaagtggtacggcaagtacctcaacacccctttgggccgcaccgtgattttaacggttcagttcactctcggctggcatttgtacttag

SEQ ID NO: 16447 - DNA, 339 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctccaccatttcaacactggcttcctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16448 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 16449 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcagtctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16450 - DNA, 362 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaaaagccatcgacgccaccattccaacaccggatccctcgagagggatgaagtgtttgtccccaagaagaagtcagacatcaagtggtacggcaagtacctcaacaaccctttgagacgcaccgtgatgttaacggttcagttcactctcggctggcctttgtacttag

SEQ ID NO: 16451 - DNA, 352 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacactggctccctcgagagagacgaagtgtttgtccccaagaagaagtcagacatcaagtggtacgccaagtccctcaccgcccctgtgggacgcaccgtgatgttaacgtttccgttccctctcggctggcctttttacttag

SEQ ID NO: 16452 - DNA, 350 bp, Artificial
  Mutation in BnaA.FAD2.a introduced by TALE nuclease pair BnFAD2_T02
cctctcctccctcaccctctcccttacttcgcctggcctctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16453 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgagtgcggccaccacgccttcagcgactaccagtggctggacgccaccgtcggcctcatcttccactccttcctcctcgtcccttacttctcctggaagtagtcatcgacgcaaccattccaacactggctccctcgagagagacgaagtgtttgtccccaagaagaagtcagacatcaagtggtacggcaagtacctcaacaaccctttgggacggaccgtgaggttaacggttcagttgactctcggctggccttagtacgtag

SEQ ID NO: 16454 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaagtagtcatcgacgccaccattccaacactggctccctcgagagagacgaagtgtttgtccccaagaagaaatccgacatcaagtggtacggcaagtacctcaacaaccctttgggacgcaccgtgatgttaacggttcagttcactctcggctggcctttgtacttag

SEQ ID NO: 16455 - DNA, 360 bp, Artificial
  Mutation in BnaA.FAD2.a introduced by TALE nuclease pair BnFAD2_T02
cctctcatccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16456 - DNA, 323 bp, Artificial
  Mutation in BnaA.FAD2.a introduced by TALE nuclease pair BnFAD2_T02
cctctcctccctcaccctctaccttacctcgcctggcccctctcctgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtaccgctcgccgcagccgaacgaccgagaagaagtcagacatcaagtggtacggcaagtacctcaacaaccctttgggacgcaccgtgatgttaacggttcagttcactctcggctggcctttgtacttag

SEQ ID NO: 16457 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccctacttctcctggaagtacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16458 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaaagtacagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacgtag

SEQ ID NO: 16459 - DNA, 360 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 16460 - DNA, 443 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtgcaatgcactgacgggtgccccgctcaacttgacccctctccagcgcctgcttgccgccttcgtggctggcgatggccaccaccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgagtacttag

SEQ ID NO: 16461 - DNA, 356 bp, Artificial
  Mutation in BnaA.FAD2.a introduced by TALE nuclease pair BnFAD2_T02
cctctcctccctcaccctctcccttacctcgcctggcccctctcctgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacgtttcagttcactctcggctggcctgtgtacttag

SEQ ID NO: 16462 - DNA, 356 bp, Artificial
  Mutation in BnaA.FAD2.a introduced by TALE nuclease pair BnFAD2_T02
cctctcctccctcaccctctcccttacctcgcctggcccctctcctgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16463 - DNA, 321 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 16464 - DNA, 329 bp, Artificial
  Mutation in BnaA.FAD2.a introduced by TALE nuclease pair BnFAD2_T02
cctctcctccctcaccctctcacttacctcgcctggcccctctactgggcctgccagggctgcgtcctaaccggcgtctgggtcatagcccacgagtgcggccaccacgccttcagcgactaccagtggctggacgacaccgtaggcctcatcttccactaccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16465 - DNA, 387 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtccctttgcctggcacagcaccggcaacagccgctggaccgtctccagctgtcatcgacgcaaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16466 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttggaacgcaccgtgatgttaacggttcagttcactctcggctggcctttgtacttag

SEQ ID NO: 16467 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagttcggccaccacgccttcagcgactaccagtggctggacgacaccgtcggcctcatcttccactccttcctcctcgtcccttacttctcctggaaagtacagtcatcgacgccaccattccaacactggctccctcgagagagacgaagtgtttgtccccaagaagaagtcagacatcaagtggtacggcaagtacctcaacgaccctgtgggacgcaccgtgatgttaacggttcagttccctctcggctggcctttgtacttag

SEQ ID NO: 16468 - DNA, 372 bp, Artificial
  Mutation in BnaA.FAD2.a introduced by TALE nuclease pair BnFAD2_T02
cctctcctccctcaccctctctcctacttcgcctggcctctctaatgggcctgccagggctgcgtcctaaccggcgtctgggtcatagcccacgagtgcggccaccacgccttcagcgactaccagtggctggacgacaccgtcggcctcatcttccactccttcctcctcgtcccttactcaagtcagaggtggcgaaacccgacagtcatcgacgccaccattccaacactggctccctcgagagagacggagtgtttgtccccaagaagaagtcaaacaacgagtggtacggcgaggacctcaacaaacctttgggacgcaccgggatgttaacggtgcaggtcactcgcgggtggcatgtgtacttag

SEQ ID NO: 16469 - DNA, 447 bp, Artificial
  Mutation in BnaA.FAD2.a introduced by TALE nuclease pair BnFAD2_T02
cctctcctccctcaccctctctcctacttcgcctggactctctactgcgcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagcaatgacattcttgcaggtatcttcgagccagccacgatcgacattgatctggctatcttgctgacaaaagcaagagaacatagcgttgcctcatcgacgccaccattccaacactggctccctcgagagagacgaattgtttgtccccaagaagaagtcagacatcaagtggtacggcaattacctcaccacccctgttggacgcaccgtaaggttaacggttccgttcactctcggcgggcctttgtacttag

SEQ ID NO: 16470 - DNA, 351 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctgcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16471 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16472 - DNA, 354 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctcagtcatcgacgccaccattccaacactggctccctcgagagagacgaagtgtttgtccccaagaagaagtcagacatcaagtggtacggcaagtacctcaacaaccatttgggacgcaccgtgatgttaacggttcagttcactctcggctggcctttgtacttag

SEQ ID NO: 16473 - DNA, 383 bp, Artificial
  Mutation in BnaA.FAD2.a introduced by TALE nuclease pair BnFAD2_T02
cctctcctccctcaccctctctcctacttcacctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagactgagcctttcgttttatttgatgcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 16474 - DNA, 411 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacgcataccgctagccaggaagagtttgtagaaacgcaaaaaggccatccccagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcactctcggctggcctttgtacttag

SEQ ID NO: 16475 - DNA, 411 bp, Artificial
  Mutation in BnaA.FAD2.a introduced by TALE nuclease pair BnFAD2_T02
cctctcctccctcaccctctctcctacttcgcctggactctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggtggcaagcaggcgctggagacggtccagcggctgttgccggtgctgtgccaggcccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16476 - DNA, 342 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaccggataccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16477 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtatacagtcatcgacgccaccattccaacactggctccctcgagagggatgaagtgttcgtccccaagaagaaatccgacatcaagtggtacggcaagtacctcaacaacccttggggacgcaccgtgatgttaacggttcagttcactctcggctggcctttgtacttag

SEQ ID NO: 16478 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctacagccatcgacgccaccattccaacaccggatccctcgagagatacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16479 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 16480 - DNA, 389 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtctggcgccgtcgggcttcctggagccgcccagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16481 - DNA, 329 bp, Artificial
  Mutation in BnaA.FAD2.a introduced by TALE nuclease pair BnFAD2_T02
cctctcctccctcaccctctctcctgcttcgtctggcctgcctactcggcctcccagcgctgcgtcctaaccggcgtctgggtcatagcccacgagtgcggccaccacgccttcagcgactaccagtggctggacgacaccgtcggtctcatcttccactaccagtcatcgacgccaccattccaacactggctccctcgagagagacgaagtgtttgtccccaagaagaagtcagacatcaagttgtacggcaaatcccccaacacctctgtggtacgcaaggtgctgccaccggtcccgctccctctcggctggcctttgtacttag

SEQ ID NO: 16482 - DNA, 357 bp, Artificial
  Mutation in BnaA.FAD2.a introduced by TALE nuclease pair BnFAD2_T02
cctctcctccctcaccctctctcctacttcgcctggcctctctaatgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaacccgttgggacgcaccgtgatgttaacggttcagttctctctcggctggcatttgtacgtag

SEQ ID NO: 16483 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggatgcgtcctaacgggcctctgggtcatcgcccacgaatgcggccaccacgccttcagcgaccaccagtggctggacgacgccgtgggcctcgtcttccactccttcctcctcgtcccttacttctcctggaagtttcatcgacgccaccattccaacactggctccctcgagagagacgaagtgtttgtccccaagaagaagtcagacatcaagtggtacggcaagtacctcaacaaccctttgggacgcaccgggatgttaacggtgcagttcactctcggctggcctttgtacttag

SEQ ID NO: 16484 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaattgtttgtccccaagaagaagtcagacatcaagtggtacggcaagtacctcaacaaccctttgggacgcaccgtgatgttaacggttcagttcactctcggctggcctttgtacttag

SEQ ID NO: 16485 - DNA, 401 bp, Artificial
  Mutation in BnaA.FAD2.a introduced by TALE nuclease pair BnFAD2_T02
cctctcctccctcaccctctctcctacttcgcctggactctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggcgctggagacggtccagcggctgttgccggtgctgtgccaatagtcatcgacgccaccattccaacactggctccctcgagagagacgaagtgtttgtccccaagaagaagtcagacatcaagtggtacggcaagttcctcagcaaccgttggggacgcgccgtggggttaacggtgcagttcactctcggctggcctgtgtacttag

SEQ ID NO: 16486 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaacacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16487 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgaccaccagtggctggacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16488 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtccggcaagtacctcaacaaccctttgggacgcaccgtgatgttaacggttcagttcactctcggctgacctttgtacttag

SEQ ID NO: 16489 - DNA, 346 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16490 - DNA, 344 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttactcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16491 - DNA, 357 bp, Artificial
  Mutation in BnaA.FAD2.a introduced by TALE nuclease pair BnFAD2_T02
cctctcctccctcgccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggctggcctttgtacttag

SEQ ID NO: 16492 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttccctctcggctggcctttgtacttag

SEQ ID NO: 16493 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacgggaagtacctcaacaaccctttgggacgcaccgtgatgttaacggttcagttcactctcggctggcctttgtacttag

SEQ ID NO: 16494 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcatcgacgccaccattccaacactggctccatcgagagagacgaagtgtttgtccccaagaagaagtcagacatcaagtggtacggcaagtacctcagcaacccttggggacggaccgtgatgttaacggttcagttcactctcggctggcctttgtacttag

SEQ ID NO: 16495 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16496 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 16497 - DNA, 387 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctgggcctggcacagcaccggcaacagccgctggacagtcatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16498 - DNA, 365 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttcctcctcgtcccttacttctcatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 16499 - DNA, 412 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgctgaaccacatcaccaactgcaacggcgccgtgctgtccgtggaggagctccagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16500 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggactacaccgtcggcctcatcttccactccttcctcctcatcccttacttctcctcagtcatcgacgccaccattccaacactggctccctcgagagagacgaagtgtttgtccccaagaagaagtcagacatcaagtggtacggcgagtacctcaacaaccctttggatcgcaccgtgatgttaccggttcagttcactctcggctggcctttgtacttag

SEQ ID NO: 16501 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggcttgacgacaccgtcggtctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccttgtgggacgcaccgtgatgttaacggttcagttcactctcggctggcctttgtacttag

SEQ ID NO: 16502 - DNA, 356 bp, Artificial
  Mutation in BnaA.FAD2.a introduced by TALE nuclease pair BnFAD2_T02
cctctcctccctcaccctctcccttacctcgcctggcacctctactgggcctgccaaggctgcgtcctaccgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 16503 - DNA, 354 bp, Artificial
  Mutation in BnaA.FAD2.a introduced by TALE nuclease pair BnFAD2_T02
cctcctccccaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16504 - DNA, 344 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacaccgtcggcctcatcttccactccttcctcctcgtcccttcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16505 - DNA, 355 bp, Artificial
  Mutation in BnaA.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16506 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16507 - DNA, 348 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttcttcatcgacgccaccattccaacactggctccctcgagagagacgaagtgtttgtccccaagaagaagtcagacatcaagtggtacggcaagtacctcaacacccctgtgggacgcaccgtgatgttaacggttcagttcactctcggctggcctttgtacttag

SEQ ID NO: 16508 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcgtcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16509 - DNA, 303 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16510 - DNA, 357 bp, Artificial
  Mutation in BnaA.FAD2.a introduced by TALE nuclease pair BnFAD2_T02
cctctcctccctcaccctctctcctacttcgcctggcctctctcctgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16511 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcgtcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16512 - DNA, 366 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacaatacagtcatcgacgccaccattccaacactggctccctcgagagagacgaagtgtttgtccccaagaagaaatccgacatcaagtggtacggcaagtacctcaacaaccctttgggacgcaccgtgatgttaacggttcagttcactctcggctggcctttgtacttag

SEQ ID NO: 16513 - DNA, 336 bp, Artificial
  Mutation in BnaA.FAD2.a introduced by TALE nuclease pair BnFAD2_T02
cctctcctccctcaccctctccctttcctcgcctggcccctctactgggcctgccaaggctgcgtcctaacgggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16514 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggaagtcatcgacgccaccattccaacactggctccctcgagagagacgaagtgtttgtccccaagaagcagtcagacatcaagtggtacggcaagtacctcaacaaccctttgggacgcaccgtgatgttaacggttcagttcactctcggctggcctttgtacttag

SEQ ID NO: 16515 - DNA, 356 bp, Artificial
  Mutation in BnaA.FAD2.a introduced by TALE nuclease pair BnFAD2_T02
cctctcctccctcaccctctcccttacctcgcctggcccctatactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 16516 - DNA, 356 bp, Artificial
  Mutation in BnaA.FAD2.a introduced by TALE nuclease pair BnFAD2_T02
cctctcctccctaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16517 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 16518 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttcctctccttcctcctcgtcccttacttctcctggaatcatcgacgccaccattccaacactggctccctcgagagagacgaagtgtttgtccccaagaagaagtcagacatcaagtggtacagcaagtacctcaacaaccctttgggacgcaccgtgatgttaacggttcagttcactctcggctggcctttgtacttag

SEQ ID NO: 16519 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 16520 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccgtttgggacgcacagggatgttaacggttcagttcactctcggctggcctttgtacttag

SEQ ID NO: 16521 - DNA, 340 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaattccaacactggctccctcgagagagacgaagtgtttgtccccaagaagaagtcagacatcaagtggtacggcaagtacctcaacaaccctttgggacgcaccgtgatgttaacggttcagttcactctcggctgaccttttacttag

SEQ ID NO: 16522 - DNA, 372 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttactcaagtcagaggtggcgaaacccgacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16523 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 16524 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcatcgacgccaccattccaacactggctccctcgagagatacgaagtgtttgtccccaagaagaagtcagacatcaagtggttcggcaagtacctcaacagcccgttgggtcgcaccgtgatgttaacggttcatttcactctcggctgccattagtacttag

SEQ ID NO: 16525 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 16526 - DNA, 357 bp, Artificial
  Mutation in BnaA.FAD2.a introduced by TALE nuclease pair BnFAD2_T02
cctctcctccctcaccctctcccctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16527 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaatgtcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggctggcctttgtacttag

SEQ ID NO: 16528 - DNA, 347 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcatcgacgccaccaatccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 16529 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgacttag

SEQ ID NO: 16530 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcgtcttccactccttcctcctcgtcccttacttctcctggatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16531 - DNA, 427 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgtgcctcgtcttccactccttcctcctcgtcccttacttctcctggaagtgggtcaagccgtgggcctggcacagcaccggcaacagccgctggaccgtctccagcgcctgcttgcacagtcatcgacgccaccattccaacactggctccctcgagagagacgaagtgtttgtccccaagaagaaatccgacatcaagtggtacggaaagtacctcaacaaccctttgggacgcaccgtgatgttaacggttcagttcactctcggctggcctttgtacttag

SEQ ID NO: 16532 - DNA, 358 bp, Artificial
  Mutation in BnaA.FAD2.a introduced by TALE nuclease pair BnFAD2_T02
cctctcctccctcaccctctcccctacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccatcgacgccaccattccaacaccggatccctcgagagggatgaagtgttcgtccccaagaagaaatccgacatcaagtggtacggaaagtacctcaacaaccctttgggacgcaccgtgaggttaacggtgcagttcactctcggctggcctttgtacttag

SEQ ID NO: 16533 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16534 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaaaaaccctttgggacgcgccgtgagtttaacggttcaagtgactcctggttgccttttgtacttag

SEQ ID NO: 16535 - DNA, 319 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 16536 - DNA, 349 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgtgtcatcgcccacgaatgcggccaccacgccttcagcgaccaccagtggctggacgacgccgtgggcctcgtcttccactccttcctcctcgtcccttacttctcctgtcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16537 - DNA, 330 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16538 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16539 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcatgtggtacggcaagtacctcaacaaccctgtgggacgcaccgtgatgttaacggttcagttcactctcggctggcctttgtacttag

SEQ ID NO: 16540 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcgaccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16541 - DNA, 350 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16542 - DNA, 294 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctccttgtcaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 16543 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagggatgaagtgtccgtccccaagaagaaatccgacatcaagtggtacggcaagtacctcaacaaccctttgggacgcaccgtgatgttaacggttcagttcactctcggctggcctttgtacttag

SEQ ID NO: 16544 - DNA, 357 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacatcgacgccaccattccaacactggctccctcgagagagacgaagtgtttgtccccaagaagaagtcagacatcaagtggtacggcaagtacctcaacaaccctttgggacgcagcgtgatgttaacggttcagttcactctcggctggcctttgtacttag

SEQ ID NO: 16545 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctactggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16546 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtgactggacgacgccgtgggcctcgtcttccactccttcctcctcgtcccttacttctcctggaagtatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16547 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 16548 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16549 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcccaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16550 - DNA, 367 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacacacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtgcttag

SEQ ID NO: 16551 - DNA, 367 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacacacacagtcatcgacgccaccattccaacactggctccctcgagagagacgaagtgtttgtccccaagaagaaggcagacatcaagtggtacggcaagtacctcaacaaccctttgggacgcaccgtgatgttaacggttcagttcactctcggctggcctttgtacttag

SEQ ID NO: 16552 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgaatgcggccaccacgccttcagcgactaccagtggctggacgacaccgtcggcctcatcttccactccttcctcctcgtcccttacttctcctggaagtatcatcgacgccaccattccaacactggctccctcgagagggatgaagtgttcgtccccaagaagaaatccgccatcaagtggtacggaaagtacctcaacaaccctttgggacgcaccgtgatgttaacggttcagttcactctcggctggcctttgtacttag

SEQ ID NO: 16553 - DNA, 386 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagcaatattggtggcaagcaggcgctgtcgggttatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16554 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 16555 - DNA, 363 bp, Artificial
  Mutation in BnaA.FAD2.a introduced by TALE nuclease pair BnFAD2_T02
cctctcctccctcaccctctcccttacctcgcctggcccctctaatgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatacagccatcgacgccaccattccaacactggctccctcgagagagacgaagtgtttgtccccaagaagaagtcagacatcaagtggtacggcaagtgcctcaacaaccctttgggacgcaccgtgatgttaacggttcagttcactctcggctgtcctttgtacttag

SEQ ID NO: 16556 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16557 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtgggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16558 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttactcctcgtcccttacttatcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16559 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 16560 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16561 - DNA, 407 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactgcttcctcctcgtcccttacttctcctggaagtacggtgctgttccgggcgatctcgatcagctcgatgtactcgtgggacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16562 - DNA, 355 bp, Artificial
  Mutation in BnaA.FAD2.a introduced by TALE nuclease pair BnFAD2_T02
cctctcctccctcaccctctctcctacttcgcctgccatccctactgggcctgccagggctgcgtcctcaccggcgtctgggtcatagcccacgagtgcgtccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtaccccaacaaccctgtgggacgcaccggaatgttaccggtccagttcactctcggctggcctgtgtacttag

SEQ ID NO: 16563 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcatcgacgcaaccattccaacactggctccctcgagagagacgaagtgtttgtccccaagaagaagtcagacatcaagtggtacggcaaggacctcaacaaccgtttgggacgcaccgtgatgttaacggtgcagttcactctcggctggactttgtacttag

SEQ ID NO: 16564 - DNA, 441 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagctcggtttgatcgacagtggcgcagcaccacgaggcactggtcggccacgggtttacacacgcgcacatcgttgcgttaagccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16565 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctccttgtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 16566 - DNA, 360 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16567 - DNA, 420 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcctcttccactccttcctcctcgtcccttacttctcctggaagtacattccgtggcgttatccagctaagcgcgaactgcaatttggagaatggcagcgcaatgacacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttttgtacttag

SEQ ID NO: 16568 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggaaagtacctcaacaaccctttgggacgcaccgtgatgttaacggttcagttcactctcggctggcctttgtacttag

SEQ ID NO: 16569 - DNA, 387 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtccctttgcctggcacagcaccggcaacagccgctggaccgtctccagctgtcatcgacgcaaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16570 - DNA, 356 bp, Artificial
  Mutation in BnaA.FAD2.a introduced by TALE nuclease pair BnFAD2_T02
cctctcctccctcaccctctctcctacttcgcctggcctctctcctgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaactcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 16571 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16572 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacaccggatccctcgagagggatgaagtgttcgtccccaagaagaaatccgacatcaagtggtacggaaagtacctcaacaacccgctaggacgcacggtgatgctaacggttcagttcactctcggctggcctttgtacttag

SEQ ID NO: 16573 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacacagtcatcgacgccaccattccaacactggctccatcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 16574 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16575 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 16576 - DNA, 294 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctccttgtcaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16577 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 16578 - DNA, 356 bp, Artificial
  Mutation in BnaA.FAD2.a introduced by TALE nuclease pair BnFAD2_T02
cctctcctccctcaccctctaccttacctcgcctggcctctctactgggcctgcaagggctgcgtcataaccggcgtatgggtcatagcccacgagtgcggccaccacgccttcagcgactaccagtggctggacgacaccgtcggcctcatcttccactccttcctcctcgtcccttacttctcctggaagccatcgacgccaccattccaacaccggatccctcgagagggatgaagtgttcgtccccaagaagaagtcagacatcaagtggtactgcaagtacctcaacaaccctttgggacgcaccgtgatattaacggttccgttcactctcggcttgcctttgtacttag

SEQ ID NO: 16579 - DNA, 356 bp, Artificial
  Mutation in BnaA.FAD2.a introduced by TALE nuclease pair BnFAD2_T02
cctctcctccctcaccctctctcctacttcgcctggactctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgctaggacgcacggtgatgctaaccgtccatttcacgctcggctggcctttgtacttag

SEQ ID NO: 16580 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccagtccaacactggctccctcgagagagacgaagtgtttgtccccaagaagaagtcagacatcaagtggtacggcaagtacctcaacaaccctgtgggacgcaccgtgatggtaacggttcagttcactctcggctggccttggtacgtag

SEQ ID NO: 16581 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaacagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 16582 - DNA, 315 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccaatggcggtggcaagcaggcgctggagccatcgacgccaccattccaacactggctccctcgagagagacgaagtgtttgtccccaagaagaagtcagacatcaagtggtccggcaagtacctcaacaaccctttgggacgcaccgtgatgttaacggttcagttcactctcggctggcctttgtacttag

SEQ ID NO: 16583 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 16584 - DNA, 311 bp, Artificial
  Mutation in BnaA.FAD2.a introduced by TALE nuclease pair BnFAD2_T02
cctctcctccctcaccctatctcctacttcgcctggcctctctactgggcctgccagggctgcgtcctaaccggcctctgggtcatcgcccacgaatgcgaccaccacgccttcagcgaccaccagtggctggacgacgccgtcggtctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggatgcctttgtacttag

SEQ ID NO: 16585 - DNA, 340 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16586 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16587 - DNA, 362 bp, Artificial
  Mutation in BnaA.FAD2.a introduced by TALE nuclease pair BnFAD2_T02
cctctcctccctcaccctctcacttaccccgcctggcccctctcctgggcctgccagggctgcgtcctaaccgccgtctgggtcatagcccacgagtgcggccaccacgccttcagcgactaccagtggctggacgacaccgtcggcctcatcttccactccttcctcctcgtcccttacttctcctggaaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 16588 - DNA, 311 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgtctttgtccccaagaagaagtcagacatcaagtggtacggcaagtacctcaacaaccctttgggacgcaccgtgatgttaacggttcagttcactctcggctggcctttgtacttag

SEQ ID NO: 16589 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 16590 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaagatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16591 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccatcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 16592 - DNA, 352 bp, Artificial
  Mutation in BnaA.FAD2.a introduced by TALE nuclease pair BnFAD2_T02
cctctcctccctcaccctctcccttacctcgcctggcccctctactgggcctgccaaggatgcgtcctaacgggcctctgggtcatagcccacgagtgcggccaccacgacttcagcgaccaccagtggctggacgacgccgtgggcctcgtcttccactccttcctcctcgtcccttacttctcctggaatcgacgccaccattccaacaccggatccctcgagagagacgaagtgtttgtccccaagaagaagtcagacatcaagtggtacggcaagtacctcaacaaccctttgggacgcaccgggatgttaacgtttcagttcactctcggctggcctttgtacttag

SEQ ID NO: 16593 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16594 - DNA, 348 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttccgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttgtacttag

SEQ ID NO: 16595 - DNA, 291 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggaagactggctccctcgagagagacgaactgtttgtccccaagaagaagtcagacatcaagtggtacggcaagtacctcaacaaccctttgggacgcaccgtgatgttaacggttcagttcactctcggctggcctttgtacttag

SEQ ID NO: 16596 - DNA, 355 bp, Artificial
  Mutation in BnaA.FAD2.a introduced by TALE nuclease pair BnFAD2_T02
cctctcctccctcaccctctcccttacctcgcctggtccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16597 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcttgcctttgtacttag

SEQ ID NO: 16598 - DNA, 357 bp, Artificial
  Mutation in BnaA.FAD2.a introduced by TALE nuclease pair BnFAD2_T02
cctctcctccctcaccctctcacttacctcgcctggcccctctcctgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacaacggcgagctttgatcaacgaccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctgtgtacttag

SEQ ID NO: 16599 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagatcgacgccaccattccaacactggctccctcgagagagacgaagtgtttgtccccaagaagaaatccgacatcaagtggtacggaaactacctcaacaacccgctaggacgcacggtgatgctaaccgtccagttcacgctcggctggcctttgtacttag

SEQ ID NO: 16600 - DNA, 357 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatatcccacgagtgcggccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16601 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccacaacgccttcagcgactaccagtggctggacgacaccgtcggcctcatcttccactccttcctcctcgtcccttacttctccagtcatcgacgccaccattccaacactggctccctcgagagagacgaagtgtttgtccccaagaagaagtcagacatcaagtggtacggcaagtacctcaacaaccctttgggacgcaccgtgatgttaacggttaagttcactctcggctggcctttgtacttag

SEQ ID NO: 16602 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 16603 - DNA, 411 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagtcttcatgaaggtgtacggctacaggggcaagcacctgggcggctccaggaagcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16604 - DNA, 291 bp, Artificial
  Mutation in BnaA.FAD2.a introduced by TALE nuclease pair BnFAD2_T02
cctctcctccctcaccctctctcatacttcgcctggcctctctactgggcctgccagggctgcgtcctaaccggcgtctgggtcatagcccacgagtgcggccaccacgccttcagcgactaccagtggctggacgacaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16605 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatacagtcatcgacgccgccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16606 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcctctgggtcatcgcccacgaatgcggccaccacgccttcagcgaccaccagtggctggacgacgccgtgggcctcgtcttccactccttcctcctcgtcccttacttctcctgtcatcgacgccaccattccaacactggctccctcgagagagacgaagtgtttgtccccaagaagaagtcagacatcaagtggtacggcaagtacctcaacaaccctttgggacgcaccgtgatgctaaccgtccagttcacgctcggctggcctttgtacttag

SEQ ID NO: 16607 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggcctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16608 - DNA, 355 bp, Artificial
  Mutation in BnaA.FAD2.a introduced by TALE nuclease pair BnFAD2_T02
cctctcctccctcaccctctctcctacttcgcctggcctccctcctgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagcatctacgccaccattccaacactggctccctcgagagagacgaagtgtttgtccccaagaagcagtcagacatcaagtggtacggcaagtagctcaacacccctttgggacgcaccgtgatgttaacggtacagttcactctcggctggcctgtgtacttag

SEQ ID NO: 16609 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacgccgtgggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16610 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagtaacagccatcgacgccaccattccaacaccggatccctcgagagagacgaagtgtttgtccccaagaagaagtcagacatcaagtggtacggcaagtacctcaacaacccttttggacgcaccgtgatgttaacggttcagttcactctcggctggcctttgtacttag

SEQ ID NO: 16611 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgcgcctcctcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16612 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactaag

SEQ ID NO: 16613 - DNA, 350 bp, Artificial
  Mutation in BnaA.FAD2.a introduced by TALE nuclease pair BnFAD2_T02
cctctcctccctcaccctctctcctacctcgcctcccctctctacttgtcctgccagggctgcgtcctacccggcgtctgggtcataccccacgagtgcggccaccacgccttcagcgactaccagtggctggacgacaccgtcggcctcatcttccactccttcctcctcgtcccttacttctcctcatcgacgccaccattccaacactggctccctcgagagagacgaagtgtttgtccccaagaagaagtcagacatcaagtgcctcgccaagtaccccaacagccctgtgggacgcagagacaggttaagagttcagttctctctcggctggcatgtgtacttag

SEQ ID NO: 16614 - DNA, 348 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttagtcatcgacgccaccattccaacactggctccctcgagagagacgaagtgtttgtccccaagaagaagtcagacatcaagtggtacggcaagtacctcaacaaccctgtgggacgcgccgtgaggttaacggtgcagttcactctcggctggcctttgtacttag

SEQ ID NO: 16615 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcagcaaccctttgggacgcaccgtgatgttaacggttcggttcactctcggctggcctttgtacttag

SEQ ID NO: 16616 - DNA, 330 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacgccgtgggcctcgtcttccactccttcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16617 - DNA, 350 bp, Artificial
  Mutation in BnaA.FAD2.a introduced by TALE nuclease pair BnFAD2_T02
cctctcctccctcaccctctctcctacttcgcctggtctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16618 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 16619 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttcggacgcaccgtgatgttaacggttcagttcactctcggctggcctttgtacttag

SEQ ID NO: 16620 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttagc

SEQ ID NO: 16621 - DNA, 356 bp, Artificial
  Mutation in BnaA.FAD2.a introduced by TALE nuclease pair BnFAD2_T02
cctctcctccctcaccctctcccttacctcgcctggaccctctactgggcctgccaaggctgcgtcctaacgggcctctgggtcatcgcccccgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcagcaaccctttgggacgcatcgtgatgttaacgtttcagttcactctcggctggcctttgtacttag

SEQ ID NO: 16622 - DNA, 340 bp, Artificial
  Mutation in BnaA.FAD2.a introduced by TALE nuclease pair BnFAD2_T02
cctctcctccctcaccctctctcctacatcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtccctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16623 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgttatgttaacggttcagttcactctcggctggcctttgtacttag

SEQ ID NO: 16624 - DNA, 419 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacattccgtggcgttatccagctaagcgcgaactgcaatttggagaatggcagcgcaatgacacatcgacgccaccattccaacactggctccctcgagagagacgaagtgtttgtccccaagaagaagtcagacatcaagtggtacggcaagtacctcaacaaccctttgggacgcaccgtgatgttaacggtacagttcactctcggctggcctttgtacttag

SEQ ID NO: 16625 - DNA, 372 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagttgctggacgacaccgtcggcctcatcttccactccttcctcctcgtcccttactcaagtcagaggtggcgaaacccgacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16626 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 16627 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctgtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 16628 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtatcatcgacgccaccattccaacactggctccctcgagagagacgaagtgtttgtccccaagaagaagtcagacatcaagtggtacggcaagtcccccaacacccctgtgggacgcaaggtgatgttaccggttcagttccctctcggctggcctttgtacttag

SEQ ID NO: 16629 - DNA, 353 bp, Artificial
  Mutation in BnaA.FAD2.a introduced by TALE nuclease pair BnFAD2_T02
cctctcctccctcaccctctctcctacttcgcctggaccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggtcatcgacgccaccattccaacactggctccctcgagagagacgaagtgtttgtccccaataagaagtcagacatcaagtggtacggcaagtacctcaacaaccctttgggacgtgccgggattttaagggaacagttcagtctcggctggccttggtacttag

SEQ ID NO: 16630 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttaattctcctggacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtccttag

SEQ ID NO: 16631 - DNA, 344 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttatcgacgccaccattccaacaccggatccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 16632 - DNA, 347 bp, Artificial
  Mutation in BnaA.FAD2.a introduced by TALE nuclease pair BnFAD2_T02
cctctactccctcaccctctctcctacttcgcctggcctctctactgggcctgccagggctgcgtcctaaccggcgtctgggtcctagcccacgagtgcggccaccacgccttcagcgactaccagtggctggacgacaccgtcggtctcatcttccactccttcctcctcgtcccttacttctcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 16633 - DNA, 356 bp, Artificial
  Mutation in BnaA.FAD2.a introduced by TALE nuclease pair BnFAD2_T02
cctctcctccctcaccctctccattacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16634 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactta

SEQ ID NO: 16635 - DNA, 363 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16636 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatgtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 16637 - DNA, 363 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacacagtcatcgacgccaccattccaacactgggtccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16638 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtcccatcttccactccttcctcctcgtcccttacttctcctggaaagtcatcgacgccaccattccaacaccggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16639 - DNA, 455 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtccagcggctgttgccaccgccattgctggcgatggccaccacctgctggggggtcaagccgtgggcctggcacagcaccggcaacaggcgctggacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16640 - DNA, 351 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 16641 - DNA, 357 bp, Artificial
  Mutation in BnaA.FAD2.a introduced by TALE nuclease pair BnFAD2_T02
cctctcctccctctccctctctccttcttcgccttgcctctctactgggccttccatggctgcgtcctaaccggcttctgtgtcatcgcccactagtgcggcccccacgccttcagcgactaccagtggctggacgacaccgtcggcctcatcttccactccttcctcctcgtcccttacttctcctggagtgtcctcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcatgagtacttag

SEQ ID NO: 16642 - DNA, 299 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacctgctccggggtcaagccgtgggcctgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16643 - DNA, 336 bp, Artificial
  Mutation in BnaA.FAD2.a introduced by TALE nuclease pair BnFAD2_T02
cctctcctccctcaccctctcccttacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16644 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagccatcgacgccacccttccaacactggctccctcgagagagacgaagtgtttgtccccacgaagaagtcagacatcaagtggcacggcaagtccctcaacacccctctgggaagcaccgtgatgttaacggttcagttcactctcggctggccttagtacttag

SEQ ID NO: 16645 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 16646 - DNA, 353 bp, Artificial
  Mutation in BnaA.FAD2.a introduced by TALE nuclease pair BnFAD2_T02
cctctcctccctcaccctctctcctacttcgcctggcctctctactgagcctgccagggctgcgtcctaaccggcgtctgggtcatagcccacgagtgctgccaccacgccttcagcgactaccagtggcttgacgacgccgtcggtctcatcttccactccttcctccccgtcccttacttctcctgatcatcgacgccaccatgccaacactggctccctcgagcgagccgaagtgtttgtccccaagaagcagtcacacctcacgtggtacggcaactacccaaacaaccctccgggccgccccctgaggttaacggttcagatccctctcggccgtcctttgcacctac

SEQ ID NO: 16647 - DNA, 391 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtacgatgttccagattacgctatcgatatcgccggccatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 16648 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagatagacgaagtgtttgtccccaagaagaagtcagacatcaagtggtacggcaagtacctcaacaacccgctaggacgcacggtgatgctaaccggccagttcacgctcggctggcctttgtacttag

SEQ ID NO: 16649 - DNA, 393 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcggcgactaccagtggctggacgacaccgtcggcctcatcttccactccttcctcctcgtcccttacttctcctggaagtacaacactggctccctcgagagagacgaagtgtttgtcatcgacgccaccattccaacactggctccctcgagagagacgaagtgtttgtccccaagaagaagtcagacatcaagtggtacggcaagtacctcaacaaccctttgggacgcaccgggatgttaacggtgcagttcactctcggctggcctttgtacttag

SEQ ID NO: 16650 - DNA, 355 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaagtatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16651 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16652 - DNA, 358 bp, Artificial
  Mutation in BnaA.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 16653 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16654 - DNA, 413 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacaggcccacggcttgaccccccagcaggtggtggccatcgccagcaatggcggtggcagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16655 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgacttag

SEQ ID NO: 16656 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggacgtcatcgacgccaccattccaacactggctccctcgagagagacgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 16657 - DNA, 339 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatatcccacgagtgcggccaccacgccttcagcgactaccagtggcttgacgacaccgtcggtctcatcttccactccttcctcctcgtcccttacgacgccaccattccaacactggctccctcgagagagacgaagtgtttgtccccaagaagaagtcagacatcaagtggtacggcaagtacctcaacaaccctttgggacgcaccgtgatgctaaccgtccagttcacgctcggctggcctttgtacttag

SEQ ID NO: 16658 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacagttcagttcactctcggctggcctttgtacttag

SEQ ID NO: 16659 - DNA, 350 bp, Artificial
  Mutation in BnaA.FAD2.a introduced by TALE nuclease pair BnFAD2_T02
cctctcctccctcaccctctctcctacttcacctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttgtacttag

SEQ ID NO: 16660 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacaacggcgagctttgatcaacgaccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16661 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcaagctcggctggcctttgtacttag

SEQ ID NO: 16662 - DNA, 349 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttaatcgtgtcatcgacgccaccattccaacactggctccctcgagagagacgaagtgtttgtccccaagaagaagtccgacatcaagtggtacggcaagtacctcaacaaccctttgggacgcaccgtgatgttaacggttcagttcactctcggctggcctttgtacttag

SEQ ID NO: 16663 - DNA, 344 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16664 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcagcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 16665 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttacagtcatcgacgccaccattccaacactggctccctcgagagagacgaagtgtttgtccccaagaagaagtcagacatcaagtggtacgacaagtacctcaacaaccctttgggacgcaccgtgatgttaacggttcaggtgactctcggctggccttggtacttag

SEQ ID NO: 16666 - DNA, 335 bp, Artificial
  Mutation in BnaA.FAD2.a introduced by TALE nuclease pair BnFAD2_T02
cctctcctccctcaccctctcccttacctcgcctggccccgctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttactcaccattccaacactggctccctcgagagagacgaagtgtttgtccccaagaagaagtcagacatcaagtggtacggcaagtacctcaacaaccctttgggacgcaccgtgatgttaacggttcatttcactctcggctggcctttgtacttag

SEQ ID NO: 16667 - DNA, 342 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggcttgacgacaccgtcggtctcatcttccactccttcctcctcgtccctgtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 16668 - DNA, 430 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgggtggctcgagggttatttgccgactaccttggtgatcttctagtgtagccgtagttaggccaccacttcagtcatcgacgccaccattccaacactggctccctcgagagagacgaagtgtttgttcccaagaagaagtcagacatcaagtggtacggcaagtacctcaacaaccctttgggacgcaccgtgatgttaacggttcagttcactctcggctggcctttgtacttag

SEQ ID NO: 16669 - DNA, 473 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccacggcttgaccccggagcaggtggtggccatcgccagccacgatggcggcaagcaggcgctggagacggtccagcggctgttgccggtgctgtgccaggcccacggcttgaccccccagcaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16670 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16671 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacagccatttgggaagaacagtgatgttaacagttcagttcactctcggctggcctttgtacttag

SEQ ID NO: 16672 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16673 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaacccttttggacgcaccgtgatgttaacggttcagttcactctcggctggcctttgtacttag

SEQ ID NO: 16674 - DNA, 351 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggatcgacgccaccattccaacactggctccctcgagagagacgaagtgtttgtccccaagaagaagtcagacatcaagtggtacggcaagtacctcaacaacccttggggacgcaccgtgatgttaacggttcagttcgctctcggctggcctttgtacttag

SEQ ID NO: 16675 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggctaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16676 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 16677 - DNA, 355 bp, Artificial
  Mutation in BnaA.FAD2.a introduced by TALE nuclease pair BnFAD2_T02
cctctcctccctcaccctctctcctacttcgcctggcctctctcctgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 16678 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggccccatcttccactccttcctcctcgtcccttacttctcctggaaagtcatcgacgccgccattccaacactggctccctcgagagagacgaagtgtttgtccccaagaagaagtcagacatcaagtggtacggcaagtacctcaacaaccctttgaaacgcaccgtgatgttaacccgacagttctctctcggctggcctttgtgcttag

SEQ ID NO: 16679 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagtccacgagtgcggccaccacgccttcagcgactaccagtggctggacgacaccgtcggcctcatcttccactccttcctcttcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16680 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagtcatcgacgcaaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16681 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaacccttgggacgcaccgtgatgttaacggttcagttcactctcggctggcctttgtacttag

SEQ ID NO: 16682 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctcatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16683 - DNA, 415 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtacggccaccacgccttcagcgactaccagtggctggacgacaccgtcggcctcctcttccactccttcctcctcgtcccttacttctcctggaagactgggcctttcgttttatctgggtccagcggctgttgccggtgctgtgccaggcccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16684 - DNA, 426 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtacacacgcgcacatcgttgcgttaagccaacacccggcagcgttagggaccgtcgctgtcaagtatcagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 16685 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaactggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16686 - DNA, 340 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgaatgcggccaccacgccttcagcgaccaccagtggctggacgacgccgtgggcctcgtcttccactccttcctcctcgtccctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16687 - DNA, 358 bp, Artificial
  Mutation in BnaA.FAD2.a introduced by TALE nuclease pair BnFAD2_T02
cctctccttcctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16688 - DNA, 356 bp, Artificial
  Mutation in BnaA.FAD2.a introduced by TALE nuclease pair BnFAD2_T02
cctctcctccctcaccctctctcctacttcgcctggcctctatactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16689 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgcatgcggccaccacgccttcagcgaccaccagtggctggacgacaccgtcggactcatcttccactccttcctcctcgtcccttacgtctcctggaaagtcatcgacgccaccattccaacactggctccctcgagagagacgaagtgtttgtccccaagaagaagtcagacatcaagtggtacggcaagtacctcaacaaccctttgggacgcaccgagatgttaacggttcagttcactctcggctggcctttgtaattag

SEQ ID NO: 16690 - DNA, 408 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaccggtgctgtgccaggcccacggcttgaccccccagcaggtggtggccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16691 - DNA, 353 bp, Artificial
  Mutation in BnaA.FAD2.a introduced by TALE nuclease pair BnFAD2_T02
cctctcctccctcaccctctctcctacttcgcctgaactctctactgcgcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcgacgccaccattccaacactggctccctcgagagagacgaagtgtttgtccccaagaagcagtcagacatcaagtggtacggcaagtacctcaacaaccctttgggacgcaccgtgattttaacggttcagttcactctcggctggcctttgtacttag

SEQ ID NO: 16692 - DNA, 367 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcctctgggtcatcgcccacgaatgcggccaccacgccttcagcgaccaccagtggctggacgacgccgtgggcctcgtcttccactccttcctcctcgtcccttacttctcctggaagtacacacacagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 16693 - DNA, 354 bp, Artificial
  Mutation in BnaA.FAD2.a introduced by TALE nuclease pair BnFAD2_T02
cctctcctccctcaccctctctcctacttcgcctggcctctctactgggactgccagggctgcgtccaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16694 - DNA, 396 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaatcaatttgttgcaacgaacaggtcactatcagtcaaaacagtcatcgacgccaccattccaacactggctccctcgagagagacgaagtgtttgtccccaagaagaagtcagacatcaagtggtacagcaagtacctcaacaaccctttgggacgcaccgtgatgttaacggttcagttcactctcggctggcctttgtacttag

SEQ ID NO: 16695 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16696 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16697 - DNA, 366 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacaatcagaaaaggtccactgggttcgtgccttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16698 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16699 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 16700 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 16701 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttggttgtcatcgacgccaccattccaacactggctccatcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16702 - DNA, 346 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcccatcgacgccaccattccaacactggctccctcgagagagacgaagtgtttgtccccaagaagaagtcagacatcaagtggtacggcaagtacctcaacaaccctttgggacgcaccgtgatgttaacgattcagttcactctcggctggcctttgttag

SEQ ID NO: 16703 - DNA, 323 bp, Artificial
  Mutation in BnaA.FAD2.a introduced by TALE nuclease pair BnFAD2_T02
cctctcctccctcaccctctctcctacttcgcctggcccctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtaccgctcgccgcagccgaacgaccgagaagaagtcagacatcaagtggtacggcaagtacctcaacaaccctttgggacgcaccgtgatgttaacggttcagttcactctcggctggcctttgtacttag

SEQ ID NO: 16704 - DNA, 323 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtaccgctcgccgcagccgaacgaccgagaagaagtcagacatcaagtggtacggcaagtacctcaacaacccgctaggacgcacggtgatgctaaccgtccagttcacgctcggctggcctttgtacttag

SEQ ID NO: 16705 - DNA, 355 bp, Artificial
  Mutation in BnaA.FAD2.a introduced by TALE nuclease pair BnFAD2_T02
cctctcctccctcaccctctctcctacttcgcctggcctctctactgtgcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 16706 - DNA, 309 bp, Artificial
  Mutation in BnaA.FAD2.a introduced by TALE nuclease pair BnFAD2_T02
cctctcctccctcccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16707 - DNA, 358 bp, Artificial
  Mutation in BnaA.FAD2.a introduced by TALE nuclease pair BnFAD2_T02
cctctcctccctcaccctctcccctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16708 - DNA, 423 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttactttccagcgcctgcttgccgccatcgtggctggcgatggccaccacctgctggggggtcaagccgtgggcctggcacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16709 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcccatcgacgccaccattccaacacgggctccctcgagagagacgaagtgtttgtccccaagaagaagtcagacatcaagtggtacggcaagtacctcaacaacccgttgggacgcaccgtgatgttaacggtgcagttcactctcggctggcctttgtacttag

SEQ ID NO: 16710 - DNA, 312 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 16711 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggacaccacgccttcagcgaccaccagtggctgaacaccgccgtgggcctcaacttccactccttcctcctcgtcccttacctctcctggaagtcagtcatcgacgccaccattccaacactggctccctcgagagagccgcagtgcttgtccccaagcagaagtcagacatcaagtggtacggcaagtacctcaacaaccctttgaaacgcaccgtgatgttaaccccccagttcacgctcggctggcctttgtgcttag

SEQ ID NO: 16712 - DNA, 345 bp, Artificial
  Mutation in BnaA.FAD2.a introduced by TALE nuclease pair BnFAD2_T02
cctctcctccctcaccctctctcctacttcgcctggcctctctactgggcctgccagggctgcgccctaaccggcgtctgggtcatagcccacgagtgcggccaccacgccttcagcgactaccagtggctggacgacaccgtcggcctcatcttccactccttcctcctcgtcccttacttcatcgacgccaccattccaacaccggatccctcgagagggatgaagtgttcgtccccaagaagaagtcagacatcaagtggtacggcaagtacctcaacaaccctttgggacgcaccatggtgttaacggttcagttcactctcggctggcctttgtacttag

SEQ ID NO: 16713 - DNA, 330 bp, Artificial
  Mutation in BnaA.FAD2.a introduced by TALE nuclease pair BnFAD2_T02
cctctcctccctcacccctctctcctacttcacctggcctctctactgggcctgccaagggtgcgtcctaaccggcgtctgggtcatagcccacgagtgcggccaccacgccttcagcgactaccagtggctggacgacaccgtcggcctcatcttccactaccagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggcttgcctttgtacttag

SEQ ID NO: 16714 - DNA, 356 bp, Artificial
  Mutation in BnaA.FAD2.a introduced by TALE nuclease pair BnFAD2_T02
cctctcctccctcaccctctttcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16715 - DNA, 431 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacattgctggcgatggccaccacctgctggggggtcaagccgtgggcctggcacagccccggcacctgccgctgcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 16716 - DNA, 356 bp, Artificial
  Mutation in BnaA.FAD2.a introduced by TALE nuclease pair BnFAD2_T02
cctctcctccctcaccctctctcctacttcccctgtcctctctactcggcctgccagggctgcgtcccaaccagcgtctgggtcatagcccacgcgtgcggccaccacgccttcagcgactaccagtggctggacgacaccgtcggcctcctcttccactccttcctcctcgtcccttacttctcctggaaagtcatcgacgccaccattccaacactggctccctcgagagagacgaagtgtttgtccccaagaagaagtcagacttcaagtggtacggctcgtacctcaacaccgctttgggacgcaccgtgatgttaacggttcagttcactctcggcgggcttttgtactaa

SEQ ID NO: 16717 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtccattacttctcctggcatcgacgccaccattccaacactggctccctcgagagagacgaagtgtttgtccccaagaagaagtcagacatcaagtggtacggcaagtacctcaacaaccctttgggacgcgccgtgatgttaacggttcagttcgctctcggctggcatatgacttag

SEQ ID NO: 16718 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16719 - DNA, 347 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16720 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 16721 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaacagtcatcgacgccaccattccaacactggctccctcgagagagacgaagtgtttgtccccaagaagaagtcagacatcaagtggtacggcaagtacctcaacatccctttgggacgcaccgtgatgttaacggagcagttcactctcggctggcctttgtacttag

SEQ ID NO: 16722 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagctaccaccagtggctggacgacgccgtgggcctcgtcttccactccttcctcctcgtcccttacttctcctggaagttacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16723 - DNA, 359 bp, Artificial
  Mutation in BnaA.FAD2.a introduced by TALE nuclease pair BnFAD2_T02
cctctcctccctcaccctctctcctacttctcctggcctctctactgggcctgccaagggtgcgtcctaaccggcgtctgggtcatagcccacgagtgcggccaccacgccttcagcgactaccagtggctgtacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacacccctttgggacgcaccgtgatgttaaccgttcagttccctctcggctggcctttgtacttag

SEQ ID NO: 16724 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaattcatcgacgccaccattccaacactggctccctcgagagagacgaagtgtttgtccccaagaagaagtcagacatcaagtggtacggaaagtacctcaacaacccgctaggacgcacggtgatgctaaccggccagttcacgctcggctggcctttgtacttag

SEQ ID NO: 16725 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgccctaacgggcctctgggtcatcgcccacgaatgcggccaccacgccttcagcgaccaccagtggctggacgacgccgtgggcctcgtcttccactccttcctcctcgtcccttacttctcctggacatcgacgccaccattccaacactggctccctcgagagagacgaagtgtttgtccccaagaagaagtcagacatcaagtgttacggcaagtacctcaacaaccctttgggacgcaccgtgaggttaacggttcaattcactctcggctggcctttgtacttag

SEQ ID NO: 16726 - DNA, 394 bp, Artificial
  Mutation in BnaA.FAD2.a introduced by TALE nuclease pair BnFAD2_T02
cctctcctccctcaccctatctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtattgagtgagctgataccgctcgccgcagccgaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16727 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcaattcactctcggctggcctttgtacttag

SEQ ID NO: 16728 - DNA, 357 bp, Artificial
  Mutation in BnaA.FAD2.a introduced by TALE nuclease pair BnFAD2_T02
cctctcctccctcaccctctcccttacctcgcatggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctgtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16729 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagccctcgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaactgttcagttcactctcggctggcctttgtacttag

SEQ ID NO: 16730 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcctcccttacttctcctggaagcatcgacgccaccattccaacactggctccctcgagagagacgaagtgtttgtccccaagaagaagtcagacatcaagtggtacggcaactacctcaacaaccggctaggacgcgcggtgatgcttaccgtccagttcactctcggctggccttagtacctag

SEQ ID NO: 16731 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggtcatcgacgccaccattccaacactggctccctcgagagagacgaagtgtttgtccccaagaataagtcagacatcaagtggtacggcaagtacctcaacaaccctttgggacgcaccgggatgttaacggttcagttcactctcggctggcctgtgtacttag

SEQ ID NO: 16732 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagggatgaagtgttcgtccccaagaagaaatcccacatcaagtggtacggaaagtacctcaacaacccgctaggacgcagggtgatgctaaccgtccaggtcacgctcggctggcctttgtacttag

SEQ ID NO: 16733 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgagtgcggccaccacgccttcagcgactaccagtggcttgacgacaccgtcggtctcctcttccactccttcctcctcgtcccttacttctcctggaagtgtcatcgacgccaccattccaacactggctccctcgagagagacgaagtgtttgtccccaagaagaagtcagacatcaagtggtacgacaagtacctcaacaaccctgtgggacgcaccgtgatgttaacggttcagttcactctcggctggcctttgtacttag

SEQ ID NO: 16734 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacaacggcgagctttgatcaacgaccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 16735 - DNA, 356 bp, Artificial
  Mutation in BnaA.FAD2.a introduced by TALE nuclease pair BnFAD2_T02
actctcctccctcaccctctctcctactttgcctggcctctctactgggcctgccagggctgcgtcctaaccggcgtctgggtcatagccaacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtccggcaattgccgcaacaaccctttgtgacgcagcgtgatgttaacaggtcagtgctctctcggctggcctttgtacgtag

SEQ ID NO: 16736 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcctcttccactccttcctcctcgtcccttacttctcctggaaacatcgacgccaccattccaacactggctccctcgagagagacgaagtgtttgtccccaagaagaagtcagacatcaagtggtacggcaagtacctcaacaaccctttgggacgcaccgtgatgttaacgggtcagttcactctcggctggcctttgtacttag

SEQ ID NO: 16737 - DNA, 365 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggacaccacgccttcagcgaccaccagtggctggacgacaccgtcggcctcatcttccactccttcctcctcgtcccttacttctcctggaagtaactacagtcatcgacgccaccattccaacactggctccctcgagagagaggaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16738 - DNA, 407 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagttctccagcggctgttgccgccatcgtggctggcgatggccaccacctgagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 16739 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16740 - DNA, 328 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcgccaccattccaacactggctccctcgagagagacgaagtgtttgtccccaagaagaagtcagacatcaagtggtacggcaagtacctcaacaaccctttgggacgcaccgtgatgttaacggttcagttcactctcgggtggcctttacttag

SEQ ID NO: 16741 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 16742 - DNA, 451 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtgcatgcatggcgcaatgcactgacgggtgccccgctcaacttgaccccaagattgcaaaacctggcggcgtgacctccgtgggggcagtgcatggcatcgacgcctcccttccaacactggccccctcgagagagacgaagggtttgtccccaagaagaagtcagacatcaagtggtacggcaagtacctcaacaaccctttggaacgcaccgtgatgttaacggttcagttcactctcggctggcctttgtacttag

SEQ ID NO: 16743 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaactgttcagttcactctcggctggcctttgtacttag

SEQ ID NO: 16744 - DNA, 422 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacggcttgaccccggagcaggtggtggccatcgccagccacgatggcggcaagcaggcgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16745 - DNA, 389 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtatggtggccatcgccagcaatggcggtgacagtcatcgacgccaccattccaacactggctccctcgagagagacgaagtgtttgtccccaagaagaagtcagacatcaagtggtacggcaagtacctcaacaaccctttgggacgcaccgtgatgttaacggttcggttcactctcggctggcctttgtacttag

SEQ ID NO: 16746 - DNA, 358 bp, Artificial
  Mutation in BnaA.FAD2.a introduced by TALE nuclease pair BnFAD2_T02
cctctccccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16747 - DNA, 356 bp, Artificial
  Mutation in BnaA.FAD2.a introduced by TALE nuclease pair BnFAD2_T02
cctctcctccctcaccctctcccttacctcgcctgccccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16748 - DNA, 336 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16749 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtgcttag

SEQ ID NO: 16750 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacatcgacgccaccattccaacacaggctccctcgagagagacgaagtgtttgtccccaagaagaagtcagacatcgagtggtacggcaagtacctcaacaacccgctaggacgcacggtgatgctaaccgtccagttcacgctcggctggcctttgtacttag

SEQ ID NO: 16751 - DNA, 355 bp, Artificial
  Mutation in BnaA.FAD2.a introduced by TALE nuclease pair BnFAD2_T02
ctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16752 - DNA, 332 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 16753 - DNA, 356 bp, Artificial
  Mutation in BnaA.FAD2.a introduced by TALE nuclease pair BnFAD2_T02
cctctcctccctcccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16754 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacatcgacgccaccattccaacactggctccctcgagagagacgaagtgtttgtccccaagaagaagtcagacatcaagtggtacggcaagtacctcaacacgcctgtgggacgcaccgtgatgttaaccgttcagttcactctcggctggcctttgtacttag

SEQ ID NO: 16755 - DNA, 441 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtgccaggcccacggcttgaccccccagcaggtggtggccatcgccggccagcaacgtcggttcgagatggcgctcgatgacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16756 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccatacttctcctggaaggtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacatag

SEQ ID NO: 16757 - DNA, 355 bp, Artificial
  Mutation in BnaA.FAD2.a introduced by TALE nuclease pair BnFAD2_T02
cctctcctccctcaccctctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16758 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtgccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16759 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggacatcgacgccaccattccaacactggctccctcgagagagacgaagtgtttgtccccaagaagaagtcagacatcaagtggtacggcaagtacctcaacaacccttttggacgcaccgtgatgttaacggttcagttcactctctgctggcctttgtacttag

SEQ ID NO: 16760 - DNA, 356 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16761 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 16762 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16763 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggcctcatcttccactccttcctcctcgtcccttacttctccttcatcgacgccaccattccaacactggctccctcgagagagacgaagtgtttgtccccaagaagaagtcagacatcaagtggtacggcaagtacctcaacaaccctttgggacgcaccgtgatgttaacggttcatttcactctcggcttgccgttgtacttag

SEQ ID NO: 16764 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 16765 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccatcggcctcatcttccactccttcctcctcgtcccttacttctcctcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16766 - DNA, 415 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtacggccaccacgccttcagcgactaccagtggctggacgacaccgtcggcctcatcttccactccttcctcctcgtcccttacttctcctggaagactgggcctttcgttttatctgggtccagcggctgttgccggtgctgtgccaggcccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16767 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatggcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16768 - DNA, 342 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaccggatacctgatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 16769 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctgaacgacaccgtcggcctcatcttccactccttcctcctcgtcatcgacgccaccattccaacactggctccctcgagagagacgaagtgtttgtccccaagaagaagtcagacatcaagtggtacgacaagtacctcaacaaccctttgggacgcaccgtgatgttaacggttcagttcactctcggctggcctttgtacttag

SEQ ID NO: 16770 - DNA, 318 bp, Artificial
  Mutation in BnaA.FAD2.a introduced by TALE nuclease pair BnFAD2_T02
cctctcctccctcaccctctctcctacttcgcctggcctctctactgggcctgtcagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16771 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 16772 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16773 - DNA, 318 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcctcttccactccttcctcctcgtcccttacttctcctggaagtagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 16774 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcatcgacgccaccattccaacactggctccctcgagagagacgaagtgtttgtccccaagaagaagtcagacatcaagtggtacggcaagtacctcaacagccctttgggacgcaccgtgatgttaacggtgcagttcactctcggctggcctttgtacttag

SEQ ID NO: 16775 - DNA, 387 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccaagccccccagcaggtggtggccatcgccagcaatagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16776 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagcagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 16777 - DNA, 452 bp, Artificial
  Mutation in BnaA.FAD2.a introduced by TALE nuclease pair BnFAD2_T02
cctctcctccctcaccctctctcctactccgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacggccaccacctgctccggggtcaagccgtgggcctggcacagttggaaacttcggcttcccctggagagagcgagattctccgcgctgtacagtcatcgacgccaccagtccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16778 - DNA, 348 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgtgcctctgggtcatcgcccacgaatgcggccaccacgccttcagcgaccaccagtggctggacgacgccgtgggcctcgtcttccactccttcctcctcgtcccttacttagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 16779 - DNA, 362 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggcttgacgacaccgtcggcctcatcttccactccttcctcctcgtcccttacttctcctggaagtcacagccatcgacgccaccattccaacactggctccctcgagagagacgaagtgtttgtccccaagaagaagtcagacatcaagtggtacggcaagtacctcaacaaccctttgggacgcaccgtgatgttaacggttgagttcactctcggctggcctttgtacttag

SEQ ID NO: 16780 - DNA, 383 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtttgaccccggagcaggtggtggcccgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16781 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcccaaccggcgtctgggtcatagcccacgagtgcggccaccacgccttcagcgactaccagtggctggacgacaccgtcggcctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16782 - DNA, 476 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagggcctggcacagcaccggcaacagccgcaatggcgggcgtcaaactaaacagtgttggaatggtggcgtcgatgactgtgagtccaacccggtaagacacgacttatcgccactggcagcagccactggtaacaggattagcagagcgaggtatgtaggcggtaagtcgtgtgtccccaagaagaagtcagacatcaagtggtacggcaagtacctcaacaaccctttgggacgcaccgtgatgttaacggttcagttcactctcggctggcctttgtacttag

SEQ ID NO: 16783 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaaagccatcgacgccaccattccaacactggctccctcgagagagacgaagtgtttgtacccaagaagaagtcagacatcaagtggtacggcaagtacctcaacaaccctttgggacgccccgtggtgttaacggtgcaggtcactctcggctggcctttgtacttag

SEQ ID NO: 16784 - DNA, 346 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggcgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16785 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcatttgtacttag

SEQ ID NO: 16786 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgacttag

SEQ ID NO: 16787 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggacatcgacgccaccattccaacactggctccctcgagagagacgaagtgtttgtccccaagaagaaatccgacatcaagtggtacggaaagtacctcaacaaccctttgggacgcaccgtgatgttaacggttcagttcactctcggctggcctttgtacttag

SEQ ID NO: 16788 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggccttttgtacttag

SEQ ID NO: 16789 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16790 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaagtaccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16791 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacgccgtgggcctcgtcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16792 - DNA, 401 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggactgccgctgccaagttcgagagacagcacatggacagcatcgatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttttacttag

SEQ ID NO: 16793 - DNA, 391 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtaggtcgttcgctccaagctgggctgtgtgcacgaatcgacgccaccattccaacactggctccctcgagagagacgaagtgtttgtccccaagaagaagtcagacatcaagtggtacggcaagtacctcaacaacccgctaggacgcacggtgatgctaaccgtccagttcactctcggctggcctttgtacttag

SEQ ID NO: 16794 - DNA, 314 bp, Artificial
  Mutation in BnaA.FAD2.a introduced by TALE nuclease pair BnFAD2_T02
ccttcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16795 - DNA, 359 bp, Artificial
  Mutation in BnaA.FAD2.a introduced by TALE nuclease pair BnFAD2_T02
ctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtacagtcatcgacgccaccattccaacactggctccctcgagagagacgaagtgtttgtccccaagaagaaatccgacatcaagtggtacggaaagtacctcaacaacccgctaggacgcacggtgatgctaaccggccagttcacgctcggctggcctttgtacttag

SEQ ID NO: 16796 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacatcgacgccaccattccaacactggctccctcgagagagacgaagtgtatgtccccaagaagaagtcagacatcaagtggtacggcaagtacctcaacaaccctttgggacgcaccgtgatgttaacggttcagttcactctcggctggcctttgtacttag

SEQ ID NO: 16797 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggtttagttcactctcggctggcctttgtacttag

SEQ ID NO: 16798 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgccctaaccggcgtctgggtcatagcccacgagtgctgccaccacgccttcagcgactaccagtggctgcacgacaccgtaggcctcatcttccactccttcctcctcgtcccttacttctcctggaaggtcatcgacgccaccattccaacactggctccctcgagagagacgaagtgtttgtccccaagaagaagtcacacatcaagtcgtacggcaagtacctcaacatcccttttagacgcgccgtggtgttaacggttcagttccctctcggctggcctttgtacctag

SEQ ID NO: 16799 - DNA, 384 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagccacgatggcggcaagcaggcgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16800 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaagtagtcatcgacgccaccattccaacactggctccctcgagagagacgaagtgtttgtcccaaagaagaagtcagacatcaagtggtacggcaagtacctcaacaaccctttgggacgcaccgtgatgttaacggttcagttcactctcggctggcctttgtacttag

SEQ ID NO: 16801 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatagcccacgagtgcggccaccacgccctcagcgactaccagtggctggacgacaccgtcggcctcatcttccactccttcctcctcgtcccttacttctcctggagcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16802 - DNA, 407 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagccgaagtttccaaaaggtcgttgatcaaagctcgccgcgttgtttcatcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16803 - DNA, 359 bp, Artificial
  Mutation in BnaA.FAD2.a introduced by TALE nuclease pair BnFAD2_T02
cctctcctccctcaccctctcccttacctcgccaggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16804 - DNA, 387 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctgggcctggcacagcaccggcaacagccgctggacagtcatcgacgccaccattccaacactggctccctcgagagagacgaagtgtttgtccccaagaagaagtcagacatcaagtggtacggcaagtacctcaacacccctttgggacgcaccgtgatgttaacggttcagttcactctcggctggcctttgtacttag

SEQ ID NO: 16805 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcgtcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaacccgttgggacgcaccgtgatgctaaccgtccagttcacgctcggctggcctttgtacttag

SEQ ID NO: 16806 - DNA, 466 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacaacagcgcctgcaccgtctccagcgcctgcttgccaccaatattgctggcgatggccaccacctgctccggggtcaagccgtgggcctggcacagcaccggcaacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 16807 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacggcaccgtcggcctcatcttccactccttcctcctcgtcccttacttctcctggaatcatcgacgccaccattccaacactggctccctcgagagagacgaactgtttgtccccaagaagaagtcagacatcaagtggtacggcaagtacctcaacaaccctctgggacgcaccgtgatgttaacggttcagttcacgctcggctggcctttgtacttag

SEQ ID NO: 16808 - DNA, 370 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtccattacttctcctggaagtaagaaaaatacagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 16809 - DNA, 357 bp, Artificial
  Mutation in BnaA.FAD2.a introduced by TALE nuclease pair BnFAD2_T02
cctctcctccctcaccctctctcctacttcacctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacaccggatccctcgagagagacgaagtgtttgtccccaagaagaagtcagacatcaagtggtacggcaagtacctcaacaacactttgggacgcaccgtgatgttaacggttcagttcactctcggctggcctttgtacttag

SEQ ID NO: 16810 - DNA, 413 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtggcacagcaccggcaacagcgcctgcaccgtctccagcgcctgcttgccaccaatatcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 16811 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttcgtacttag

SEQ ID NO: 16812 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctgtacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16813 - DNA, 347 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16814 - DNA, 393 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacaacactggctccctcgagagagacgaagtgtttgtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 16815 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 16816 - DNA, 356 bp, Artificial
  Mutation in BnaA.FAD2.a introduced by TALE nuclease pair BnFAD2_T02
cctctcctccctcaccctctcccttacctcgcctggcccctctacggggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16817 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatctaccactccttcctcctcgtcccttacttctcctggaaagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcatttgtacttag

SEQ ID NO: 16818 - DNA, 351 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16819 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaagatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16820 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccatgccaacactggctccctcgagagagacgaagtgtttgtccccaagaagaagtcagacatcaagtggtacggcaagtacctcaacaaccctgtgggacgcacagtgatgttaacggtgcagttcactctcggctggcctttgtacttag

SEQ ID NO: 16821 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16822 - DNA, 291 bp, Artificial
  Mutation in BnaA.FAD2.a introduced by TALE nuclease pair BnFAD2_T02
cctctcctcctcaccctctctcctacttcgcctggcctctctactgggcctgccagggctgcgtcctaaccggcgtctgggtcatagcccacgagtgcggccaccacgccttcagcgactaccagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16823 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctctcagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 16824 - DNA, 347 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggcctcatcttccactccttcctcctcgtcccttacttctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16825 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16826 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16827 - DNA, 356 bp, Artificial
  Mutation in BnaA.FAD2.a introduced by TALE nuclease pair BnFAD2_T02
cctctcctccctcacactctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16828 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcataacgggcctctgggtcatcgcccacgaatgcggccaccacgccttcagcgaccaccagtggctggacgacgccgtcggcctcatcttccactccttcctcctcgtcccttacttctcctggaaagtcatcgacgcctccattccaacactggctccctcgagagagccgaagtgtttgtccccaagcagcagtcacacatcacgtggtacggcaagtacctcaacatccctctggaacgcaccctgatgtaaaccgctcaattcacgctcggctggcctttgtgcttag

SEQ ID NO: 16829 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 16830 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16831 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 16832 - DNA, 350 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16833 - DNA, 355 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggactcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16834 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16835 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16836 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggtagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 16837 - DNA, 418 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaggggaagccgaagtttccaaaaggtcgttgatcaaagctcgccgcgttgtttcatcaagcccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16838 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 16839 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 16840 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtaacagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 16841 - DNA, 350 bp, Artificial
  Mutation in BnaA.FAD2.a introduced by TALE nuclease pair BnFAD2_T02
cctctcctccatcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16842 - DNA, 357 bp, Artificial
  Mutation in BnaA.FAD2.a introduced by TALE nuclease pair BnFAD2_T02
cctctcctccctcaccctctcccttacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatcttaacggttcagttcactctcgcctggcctttgtacttag

SEQ ID NO: 16843 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16844 - DNA, 442 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagcaggtggtggccatcgccagcaatggcggtggcaagcaggcgctggagacggtccagcggctgttgccggtgctgtgccaggcccagtcatcgacgccaccattccaacactggctccctcgagagagacgaagtgtttgtccccaagaagaagtcagacatcaagtggtacggcaagttcctcaacaaccctttggggcgcaccgtgatgttaatcggagagttctctctcggctcgccgttgtacttag

SEQ ID NO: 16845 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagttgtacggcaagtacctcaacaaccctttgggacgcaccgtgatgttaacggttcagttcactctcggctggcctttgtacttag

SEQ ID NO: 16846 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttcacgacaccgtcggtctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaaccgtgcagttcactctcggctggcctttgtacttag

SEQ ID NO: 16847 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgccgccgtgggcctcggcttccactccttcctcctcgtcccttacttctcctggaaagccatcgacgccaccattccaacaccggatccctcgagagggatgaagtgttcgtccccaagaagaagtcagacatcaagtggtacggcaagtacctcaacaaccctttgggacgcaccgtgatgttaacggttcctttcactctcggctggcctttgtgctttg

SEQ ID NO: 16848 - DNA, 394 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtattgagtgagctgataccgctcgccgcagccgaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16849 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcgttctcatcttccactccttcctcctcgtcccttacttctccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16850 - DNA, 332 bp, Artificial
  Mutation in BnaA.FAD2.a introduced by TALE nuclease pair BnFAD2_T02
cctctcctccctcaccctctctcctacttcgcctggcctctctactgggcctgtcagggctgcgtcctaaccggcgtctgggtcatagcccacgagtgcggccaccacgccttcagcgactaccagtggcttgacgacaccgtcggtctcatcttccactccttcctcctcgtcccttacttctcctggaactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16851 - DNA, 346 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtgcttag

SEQ ID NO: 16852 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacagttcagttcactctcggctggcctttgtacttag

SEQ ID NO: 16853 - DNA, 358 bp, Artificial
  Mutation in BnaA.FAD2.a introduced by TALE nuclease pair BnFAD2_T02
cctctcctccctcaccctctctcctacttcgtctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtatcatcgacgccaccattccgacactggctccctcgagagagacgaagtgtttgtccccaagaagaagtcagacatcaagtggttcggcaattacctcaacaaccctttgggacgcgccgtgatgttaacggttcagttcgctctcggctggcctttgtacttag

SEQ ID NO: 16854 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatgtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 16855 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctaaacaaccctttggaacgcaccgtgatgttaaccgttcagttcactctcggctggcctttgtgcttag

SEQ ID NO: 16856 - DNA, 446 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtactttgcaagcagcagattacgcgcagaaaaaaaggatctccgctcccggcggatttgtcctactcaggagagcattcaccgacaacggtcatcgacgccgccaatccaacactggctccctcgagagagacgaagtgtttgtccccaagaagaaggcagacatcaagtggtacgtgaagtacctcaacaaccctttgggacgcaccgtgatgttaaccgttcagttctctctcggctggcctttgtacttag

SEQ ID NO: 16857 - DNA, 318 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacaccgtcggcctcatcttccactccttcctcctcgtcccttacttctcctggagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 16858 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcgaccaccacgccttcagcgaccaccagtggctggacgacgccgtgggcctcgtcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16859 - DNA, 335 bp, Artificial
  Mutation in BnaA.FAD2.a introduced by TALE nuclease pair BnFAD2_T02
actctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttactcaccattccaacactggctccctcgagagagacgaagtgtttgtccccaagaagaagtcagacatcaagtggtacggcaagtacctcaacagccctatgggtctcaccgtgatgttaacagttcagttcactctcggctagccattgtacgtag

SEQ ID NO: 16860 - DNA, 394 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaccgctcgccatgcatgcactgcctccactgcggtagtcatcgacgccaccattccaacactggctccctcgagagagacgaagtgtttgtccccaagaagaagtcagacatcaagtggtacggcaagtacctcaacaaccctttgggacgcaccgtgaggttaagggctcaattcactctcggctggctttagtacttag

SEQ ID NO: 16861 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaaatccgacatcaagtggtacggcaagtacctcaacaaccctttgggacgcaccgtgatgttaacggttcagttcactctcggctggcctttgtacttag

SEQ ID NO: 16862 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtccattacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 16863 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16864 - DNA, 356 bp, Artificial
  Mutation in BnaA.FAD2.a introduced by TALE nuclease pair BnFAD2_T02
cctttcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgttaggacgcacggtgatgctaaccgttcagttcactctcggctggcctttgtacttag

SEQ ID NO: 16865 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcacgctcggctggcctttgtacttag

SEQ ID NO: 16866 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggattcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 16867 - DNA, 384 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgcaatggcggtggcaagcaggcgctggagacggtcatcgacgccaccattccaacactggctccctcgagaaagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16868 - DNA, 352 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctgtcatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16869 - DNA, 294 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgagtgcggccaccacgccttcagcgactaccagtggcttgacgacaccgtcggcctcatcttccactccttcctccttgtcaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16870 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcggacatcaagtggtacggcaagtacctcaacaaccctttgggacgcaccgtgatgttaacggttcagttcactctcggctggcctttgtacttag

SEQ ID NO: 16871 - DNA, 389 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtctggcgccgtcgggcttcctggagccgcccagccatcgacgccaccattccaacactggctccctcgagagagacgaagtgtttgtcaccaagaagaagtcagacatcaagtggtacggcatgtacctcaacagccctttgggacgcaccgtgatgttaacgtttcagttcactctcggctggcctttgtacttag

SEQ ID NO: 16872 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagggatgaagtgttcgtccccaagaagaaatccgacatcaagtggtacggaaggtacctcaacaacccgctaggacgcacggtgatgctaaccgtccagttcacgctcggctggcctttgtacttag

SEQ ID NO: 16873 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctgtacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16874 - DNA, 355 bp, Artificial
  Mutation in BnaA.FAD2.a introduced by TALE nuclease pair BnFAD2_T02
cctctcctccctcaccctgtcccttacctcgcctctctcctctcctcggcctcccaaggatgcgccctaacgggcctctcggtcatcgcccacgaatgcggccaccacgccttcagcgaccaccagtggctggacgacgccgtggacctcgtcttccactccttcctcctcgtcccttacttctcctggaagtcatcgacgccaccattccaacactggctccctcgagagagacgaagtgtttgtccccaagaagaagtcagacatcaagcggtacggcaagtgcctcaacaacccgttgggaggcaccgtggtgttaacggttcagtgcgctctcggcgggcctttttactag

SEQ ID NO: 16875 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggccccatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16876 - DNA, 358 bp, Artificial
  Mutation in BnaA.FAD2.a introduced by TALE nuclease pair BnFAD2_T02
cctctcctccctcaccctctctcctacttcgcctggcctctctactgggcctgcccgggctgcgtcctaaccggcgtctgggtcatagcccacgagtgcggccaccacgccttcagcgactaccagtggctggacgacaccgtcggcctcatcttccactccttcctcctcgtcccttacttctcctggaagagtaatcgacgccaccattccaacactggctccctccagacagacgaagtgtttgtccccaataagaagtcacacatcaagtggtacggcaagtacctaaacatgccttcgggacgcaccgtggggttaaccgttcggttcccgctcggctggcttttgtacctag

SEQ ID NO: 16877 - DNA, 408 bp, Artificial
  Mutation in BnaA.FAD2.a introduced by TALE nuclease pair BnFAD2_T02
cctctcctccctcaccctatctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccggtgctgtgccaggcccacggcttgaccccccagcaggtggtggccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16878 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaagtatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16879 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtccattacttctcctggaacagtcatcgacgccaccattccaacactggctacctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16880 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccggaagtacagtcatcgacgccaccattccaacactggctccctcgagagagacgaagtgtttgtccccaagaagaagtcagacatcaagtggtacggcaagttcctcaacatccctttgggacgcgccgtgatgttaacggttcagttcactctcggctggcctttgtacttag

SEQ ID NO: 16881 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaagtccgccatcaagtggtccggcaagtacctcaccaaccctttgggacgcaccgtgatgttaacggttcagttcactctcggctggcctttgtacttag

SEQ ID NO: 16882 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacgccgtgggcctcgtcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16883 - DNA, 362 bp, Artificial
  Mutation in BnaA.FAD2.a introduced by TALE nuclease pair BnFAD2_T02
cctctcctccctcaccctctctcctacttagcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttacagtcatcgacgccaccattccaacactggctccctcgagagagacgaagtgtttgtccccaagaagaagtcagacatcaagtggtacggcaagtgcctcaacaaccctttgggacgcaccgtgatgttaacgggtcagttcactctcggctggcaattgtacttag

SEQ ID NO: 16884 - DNA, 363 bp, Artificial
  Mutation in BnaA.FAD2.a introduced by TALE nuclease pair BnFAD2_T02
cctctcctccctcaccctttctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtatacagtcatcgacgccaccattccaacactggctccctcgagagagacgaagtgtttgtccccaagaagaagtcagacatcaagtggtacggcaagtacctcaacaacccgtggggacgaaccgtgatgttaaccgttcagttcactctcggctgtcctgtatacgtag

SEQ ID NO: 16885 - DNA, 351 bp, Artificial
  Mutation in BnaA.FAD2.a introduced by TALE nuclease pair BnFAD2_T02
cctctcctccctcaccctctcccttacctcgcctggcccatctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 16886 - DNA, 346 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16887 - DNA, 354 bp, Artificial
  Mutation in BnaA.FAD2.a introduced by TALE nuclease pair BnFAD2_T02
cctctcctccctcaccctctctcctacttcgcctggactctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagatcgacgccaccattccaacactggctccctcgagagagacgaagtgtttgtccccaagaagaagtcagacatcaagtggtacggcaagtacctcaacaaccccttgggacgcaccgtgttgttaacggttccgtccactctcggctggcctttgtccttag

SEQ ID NO: 16888 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 16889 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacagttcagttcactctcggcttgcctttgtacttag

SEQ ID NO: 16890 - DNA, 358 bp, Artificial
  Mutation in BnaA.FAD2.a introduced by TALE nuclease pair BnFAD2_T02
cctctcctccctcaccctctctcctacttcgcctggcctctctactggacctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16891 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctagtcatcgacgccaccattccaacactggctccctcgagagagacgaagtgtttgtccccaagaagaagtcagacatcaagtggtacggcaagtacctcaacaaccctttggtacgcaccgtgatgttaacggttcagttcactctcggctggcctttgtacttag

SEQ ID NO: 16892 - DNA, 355 bp, Artificial
  Mutation in BnaA.FAD2.a introduced by TALE nuclease pair BnFAD2_T02
gctctcctccctcaccctctctccaacacagcctggcctctctactgggcagggaagggctgcgcgctaaccggcgtccggggcagagcccacgagggcggcgaccacgccttcagcgactaccagtggctggacgacaccgtcggcctcatcttccactccttcctcctcgtcccttacttctccagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttat

SEQ ID NO: 16893 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 16894 - DNA, 343 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttactatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16895 - DNA, 357 bp, Artificial
  Mutation in BnaA.FAD2.a introduced by TALE nuclease pair BnFAD2_T02
cctctcctccctcaccctatctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcacttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16896 - DNA, 336 bp, Artificial
  Mutation in BnaA.FAD2.a introduced by TALE nuclease pair BnFAD2_T02
cctctcctccctcaccctatctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctctacaaccctttgggacgcaccgtgatgttaacggttcagttcactctcggctggcctttgtacttag

SEQ ID NO: 16897 - DNA, 339 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacgacgccaccattccaacactggctacctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 16898 - DNA, 337 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcttccacagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 16899 - DNA, 451 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaagtgcatgcatggcgcaatgcactgacgggtgccccgctcaacttgaccccaagattgcaaaacgtggcggcgtgaccgcagtggaggcagtgcatgtcatcgacgccaccatgccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 16900 - DNA, 401 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcatcttccactccttcctcctcgtcccttacttctcctggaaggcgctggagacggtccagcggctgttgccggtgctgtgccaatagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16901 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16902 - DNA, 329 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccacttacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 16903 - DNA, 340 bp, Artificial
  Mutation in BnaA.FAD2.a introduced by TALE nuclease pair BnFAD2_T02
ccttcctccctaaccctctctactacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 16904 - DNA, 274 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgaatgcggccaccacgccttcagcgaccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactcag

SEQ ID NO: 16905 - DNA, 347 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctccacgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16906 - DNA, 358 bp, Artificial
  Mutation in BnaA.FAD2.a introduced by TALE nuclease pair BnFAD2_T02
cctctcctccctcaccctctcacttacctcgcctggcccctctcctgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagccatcgacgccaccattccaacactggctccctctagagagacgaagtgtttgtccccaagaagaagtcagacatcaagtggtacggcaagtacctcaacaaccctgtgggaagcaccgtgatgttaacggtgcagttcactctcggctggcctttgtacttag

SEQ ID NO: 16907 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 16908 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtgcttag

SEQ ID NO: 16909 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggtagccatcgacgccaccattccaacactggctccctcgagagagactaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16910 - DNA, 406 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcctcttccactccttcctcctcgtcccttacttctcctggaagtactccagcgcctgcttgccaccattattgctggcgatggccaccacctgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16911 - DNA, 428 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtggcgatggccaccacctgctggggggtcaagccgtgggcctggcccagcaccggcaacagccgctgggcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16912 - DNA, 441 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggaagtgtgccaggcccacggcttgaccccccagcaggtggtggccatcgccggccagcaacgtcggttcgagatggcgctcgatgacggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16913 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16914 - DNA, 347 bp, Artificial
  Mutation in BnaA.FAD2.a introduced by TALE nuclease pair BnFAD2_T02
cctctcctccctcaccctctcacttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttatccatgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16915 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaattacctcaacaaccctttgggacgcagcgtgatgttaacggttcagttcactctcggctggcctttgtacttag

SEQ ID NO: 16916 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagtacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16917 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgaatgcggccaccacgccttcagcgactaccagtggctggacgacaccgtcggcctcctcttccactccttcctcctcgtcccttacttctcctggaagttcatcgacgccaccattccaacactggctccctcgagagagacgaagtgtttgtccccaagaagaagtcagacatcaagtgatacggcaagtacctcaacaaccctttgggacgcaccatgaacttaacggtacagttcactctcggctggcctttgtacttag

SEQ ID NO: 16918 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggaagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16919 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctccttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16920 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaaaagtcatcgacgccaccattccaacactggctccctcgagagagacgaagtgtttgtccccaagaagaagtcagacatcaagtggtacggcaagtacctcaacaaccctttgggacgcacggtgatgctaaccgcccagttcacgctcggctggcctttgtacttag

SEQ ID NO: 16921 - DNA, 357 bp, Artificial
  Mutation in BnaA.FAD2.a introduced by TALE nuclease pair BnFAD2_T02
cctctcctccctcaccctgtctcctacttcgcctggcctctctcctgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaagttcatcgacgccaccattccaacactggctccctcgagagagacgaagtgtttgtccccaagaagaagtcagacatcaagtggtacggcaagtacctcaacatccctttgggacgcaccgtgatgttaacggttcaggtcacgctcgtctggcctttgtacttag

SEQ ID NO: 16922 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctctgggacgcaccgtggtggaaacggttcagttcactctcggctggcctttgtacttag

SEQ ID NO: 16923 - DNA, 346 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 16924 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 16925 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcgtcttccactccttcctcctcgtcccttacttctcctggaaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 16926 - DNA, 358 bp, Artificial
  Mutation in BnaA.FAD2.a introduced by TALE nuclease pair BnFAD2_T02
cctctcctccctcaccctctctcctacttcgcctggcctctctcctcggcctgccagggatgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtggtgttaacggttcagttcacgctcggctggcctttgtgcttag

SEQ ID NO: 16927 - DNA, 348 bp, Artificial
  Mutation in BnaA.FAD2.a introduced by TALE nuclease pair BnFAD2_T02
cctctactccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactgag

SEQ ID NO: 16928 - DNA, 464 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaaggccttggtaggtccagcggcggaggaactctttgatccggttcctgaacaggatctatttgcggcctttttacggttcctggccttttgctggccttttgctcacatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16929 - DNA, 357 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16930 - DNA, 409 bp, Artificial
  Mutation in BnaA.FAD2.a introduced by TALE nuclease pair BnFAD2_T02
cctctcctccctcaccctctctcctacttcgcctggcatctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaccttgaccgaacgcagcggtggtaacggcgcagtggcggttttcatggcttgagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 16931 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccactaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16932 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggcctgtgtacttag

SEQ ID NO: 16933 - DNA, 365 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaagtaactacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16934 - DNA, 360 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaaggcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16935 - DNA, 329 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccacttacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 16936 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttgtacttag

SEQ ID NO: 16937 - DNA, 353 bp, Artificial
  Mutation in BnaA.FAD2.a introduced by TALE nuclease pair BnFAD2_T02
cctctcctccctcaccctctcccttacctcgcctggcccctctcctgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacatcgactccaccattccaacactggctccctcgagagagacgaagtgtttgtccccaagaagaagtcagacatcaagtggtacggcaagttcctcaacaaccctttgggacgcaccgtgatgttaacggttcagttcactctcggctggcctttgtacttag

SEQ ID NO: 16938 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 16939 - DNA, 387 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggcgatggccaccacctgctccggggtcacagtcatcgacgccaccattccaacactggctccctcgagagagacgaagtgtttgtccccaagaagaaatccgacatcaagtggtacggaaagtacctcaacaacccgctaggacgcgcggtgatgctaaccgtccagttcacgctcggctggcctttgtacttag

SEQ ID NO: 16940 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 16941 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagatgaagtgttcgtccccaagaagaaatccgacatcaagtggtacggaaagtacctcaacaacccgctaggacgcaccgtgatgttaacggttcagttcactctcggctggcctttgtacttag

SEQ ID NO: 16942 - DNA, 354 bp, Artificial
  Mutation in BnaA.FAD2.a introduced by TALE nuclease pair BnFAD2_T02
cctctcctccctcaccctctctcctacttcgcctggcctatctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16943 - DNA, 351 bp, Artificial
  Mutation in BnaA.FAD2.a introduced by TALE nuclease pair BnFAD2_T02
cctctcctccctcaccctctctcctacttcgcctggcctctctcctaggcctgccagggctgcgtcctaaccggcgtctgggtcatagcccacgagtgcggccaccacgccttcagcgactaccagtggctggacgacaccgtcggcctcatcttccactccttcctcctcgtcccttacttctccttcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 16944 - DNA, 332 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccactagtgcggccaccacgccttcagcgactaccagtggctggacgacaccgtcggcctcatcttccactccttcctcctcgtcccttacttctcctggaactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16945 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtacacagccatcgacgccaccattccaacactggctccctcgagagagacgaagtgtttgtccccaagaagaagtcagacatcaagtggtacggcaagtaccccaacaaccctttgggacgcaccgtgatgttaacggttcagttcactctcggctggcctttgtacttag

SEQ ID NO: 16946 - DNA, 357 bp, Artificial
  Mutation in BnaA.FAD2.a introduced by TALE nuclease pair BnFAD2_T02
cctctcctccctcaccctctctcctacttcgcctggcctctctattgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16947 - DNA, 312 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgactaccagtggctggacgacaccgtcggcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16948 - DNA, 395 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtacggccaccacgccttcagcgactaccagtggcttgacgacaccgtcggtctcatcttccactccttcctcctcgtcccttacttctcctggaagccgccggagtaggccttggtgtccacgatcacgccgtagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 16949 - DNA, 357 bp, Artificial
  Mutation in BnaA.FAD2.a introduced by TALE nuclease pair BnFAD2_T02
cctctcctccctcaccctctcccttacctcgcctggcccctctcctgagcctgccaaggatgcgtcctaacgggcctctgggtcatcgcccacgaatgcggccaccacgccttcagcgaccaccagtggctggacgacgccgtgggcctcgtcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccgtttgggacgcaccgtgaggttaagggtgcagttgacgctcggctggcctgggtacttag

SEQ ID NO: 16950 - DNA, 352 bp, Artificial
  Mutation in BnaA.FAD2.a introduced by TALE nuclease pair BnFAD2_T02
cctctcctccctcaccctttctcctacttcgcctggcctatctactgggcctgccagggctgcgtcctaaccggcgtctgggtcatagcccacgagtgcgtccaccacgccttcagcgactaccagtggctggacgacaccgtcggcctcatcttccactccttcctcctcgtcccttacttctcctggaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16951 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctcgacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcacgctcggctggcctttgtacttag

SEQ ID NO: 16952 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcgagtggtacggcaagtacctcaacaaccctttgggacgcaccgtgatgttaacggttcagttcactctcggctggcctttgtacttag

SEQ ID NO: 16953 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggcttcctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16954 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtccctcaacaaccctttgggacgcaccgtgatgttaaccgttcagttcactctcggctggcctttgtactcag

SEQ ID NO: 16955 - DNA, 389 bp, Artificial
  Mutation in BnaA.FAD2.a introduced by TALE nuclease pair BnFAD2_T02
cctctcctccctcaccctctctcctacttcgcctggcctctctactgtgcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtatggtggccatcgccagcaatggcggtgacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16956 - DNA, 359 bp, Artificial
  Mutation in BnaA.FAD2.a introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16957 - DNA, 357 bp, Artificial
  Mutation in BnaA.FAD2.a introduced by TALE nuclease pair BnFAD2_T02
cctctcctccctcaccctctcacctacttcgcctggcatctctactgggcctgccagggctgcgtcctaaacggcgtctgggtcatagcccacgagtgcggccaccacgccttcagcgactaccagtggcttgaagacaccgtcggcctcatcttccactccttcctcctcgtcccttacttctcctggaaagtcatcgacgccaccattccaacactggctccctcgagagagacgaagtgtttgtccccaagaagaagtcgaaccacaagtggtaccgcgagtacctcaacaaccctttgggacgcaccgtgatgttaacggttcagttcactctcggctggcctttgtacttag

SEQ ID NO: 16958 - DNA, 357 bp, Artificial
  Mutation in BnaA.FAD2.a introduced by TALE nuclease pair BnFAD2_T02
cctctcctcactcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16959 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgtgggacgcaccgggatgttaacggttcagttcactctcggctggcctttgtacttag

SEQ ID NO: 16960 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccttgtcatcgacgccaccattccaacactggctccctcgagagagacgaagtgtttgtccccaagaagaagtcagacatcaagtggtacggcaagtaccgcaacatcccttggggacgcaccgtgatgttaacggttcagttcactctcggctggcatttgtacttag

SEQ ID NO: 16961 - DNA, 383 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtttgaccccggagcaggtggtggccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16962 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctccatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16963 - DNA, 357 bp, Artificial
  Mutation in BnaA.FAD2.a introduced by TALE nuclease pair BnFAD2_T02
cctatcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggctggcctttgtacttag

SEQ ID NO: 16964 - DNA, 391 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtaggtcgttcgctccaagctgggctgtgtgcacgaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16965 - DNA, 454 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgacggtccagcggctgttgccggtgctgtgccaggcccacggcttgaccccccagcaggtggtggccatcgccagcaatggcggtggcaagcaggcgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16966 - DNA, 349 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttccgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16967 - DNA, 341 bp, Artificial
  Mutation in BnaA.FAD2.a introduced by TALE nuclease pair BnFAD2_T02
cctctcctccctcaccctctctcctacttcgcctggcctctctactgggcttgccaagggcgcgtcctaaccggcgtctgggtcatagcccacgagtgcggccaccacgccttcagcgactaccagtggctggacgacaccgtcggcctcatcttccactccttcctcctcgtccagtcatcgacgccaccattccaacactggctccctcgagagagacgaagtgtttgtccccaagaagaagtcagacatcaagtggtacggctagtccctcaccaccgctgtggaacgcaccgtgatgttaaccgttcagttcactctcggctggcctttgtacttag

SEQ ID NO: 16968 - DNA, 417 bp, Artificial
  Mutation in BnaA.FAD2.a introduced by TALE nuclease pair BnFAD2_T02
cctctcctccctcaccctctcccttacctcgcctggcctctctactgggcctgccaagggtgcgtcctaaccgcgtctgggtcatagcccacgagtgcggccaccacgccttcagctactaccagtggctggacgacaccgtcggcctcatcttccactccttcctcctcgtcccttacttctcctggaagtaggggaagccgaagtttccaaaaggtcgttgatcaaagctcgccgcgttgtttcatcaagcccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttagtacttag

SEQ ID NO: 16969 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16970 - DNA, 357 bp, Artificial
  Mutation in BnaA.FAD2.a introduced by TALE nuclease pair BnFAD2_T02
ccctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaagccatcgacgccgccattccaacactggctccctcgagagagacgaagtgtttgtccccaagaagaagtcagccatcaagtggtacggcaagtacctcaacaaccctttgggacgcaccgtgatgttaaccggtcagttcactctcggctggcctttgtacttag

SEQ ID NO: 16971 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16972 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 16973 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggactacaccgtcggcctcatcttccactccttcctcctcgtcccttacttctcctggaaaagtcatcgacgccaccattccaacactggctccctcgagagagacgaagtgtttgtccccaagaagaaatccgacatcaagtggtatggaaagtacctcaacaacccgctaggacgcacggtgatgctaaccgtccagttcacgctcggctggcctttgtacttag

SEQ ID NO: 16974 - DNA, 357 bp, Artificial
  Mutation in BnaA.FAD2.a introduced by TALE nuclease pair BnFAD2_T02
cctctcctccctcacactctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16975 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16976 - DNA, 387 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtccctttgcctggcacagcaccggcaacagccgctggaccgtctccagctgtcatcgacgcaaccattccaacactggatccctcgagagagacgaagtgtttgtccccaagaagaagtcagacatcaagtggtacggaaagtacctcaacaacccgctaggacgcacggtgatgctaaccgtccaggtcacgctcggctggcctttgtacttag

SEQ ID NO: 16977 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16978 - DNA, 356 bp, Artificial
  Mutation in BnaA.FAD2.a introduced by TALE nuclease pair BnFAD2_T02
cctctcctccctcaccctctcgcttacctcgcctggcccctctcctgggcctgccaaggctgcgtcctaacgggcctctgggtcatcgcccacgaatgcggccaccacgccttcagcgaccaccagtggctggacgacgccgggggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctaaacaaccctttgggacgcaccgtgatgttaacgtttcagttcactctcggctggcctttgtacttag

SEQ ID NO: 16979 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgaatgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16980 - DNA, 339 bp, Artificial
  Mutation in BnaA.FAD2.a introduced by TALE nuclease pair BnFAD2_T02
cctctcctccctcaccctttctcctacttcgcctggcctctctactgggcctgccagggctgcgtcctaaccggcgtctgggtcatagcccacgagtgcggccaccacgccttcagcgactaccagtggctggacgacaccgtcggcctcatcttccactctttcctcctcgtcccttacttctccaccatttcaacactggcttcctcgagagagacgaagtgtttgtccccaagaagaagtcagacatcaagtggtacggcaagtacctcaacgaccctttgggacgcaccgtgatgttaacggttccgttcactctcggctggccgttgtacttaa

SEQ ID NO: 16981 - DNA, 344 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttactcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16982 - DNA, 390 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcatcttccactccttccaccaccagcaatattggtggcaagcaggcgctggagacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggccttgtacttag

SEQ ID NO: 16983 - DNA, 423 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttactttccagcgcctgcttgccgccatcgtggctggcgatggccaccacctgctggggggtcaagccgtgggcctggcacagtcatcgacgccaccattccaacactggctccctcgagagagacgaagtgtttgtccccaagaagaagtcagacatcaagtggtacggcaagtacctcaacaaccctttgtgacgcaccgtgatgttaacggttcagttcactctcggctggcctttgtacttag

SEQ ID NO: 16984 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttctcctggaagaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 16985 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16986 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctagtcatcgacgccaccattccaacaccggatccctcgagagggatgaagtgttcgtccccaagaagaaatccgacatcaagtggtacggaaagtacctcaacaaccctttgggacgcaccgtgatgttaacgggtcagttcactctcggctggcctttgtacttag

SEQ ID NO: 16987 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaacacgccttcagcgactaccagtggcttgacgacaccgtcggtctcatcttccactccttcctcctcgtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 16988 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggcctttgtacttag

SEQ ID NO: 16989 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtactgcaagtacctcaacaaccctttgggacgcaccgtgatgttaaccgtacagttcactctcggctggcctttgtgcttag

SEQ ID NO: 16990 - DNA, 471 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccagcaataatggtggcaagcaggcgctggagacggtccagcggctgttgccggtgccgtgccaggcccacggcttgaccccccagcaggtggtggccatcgccagcaatacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16991 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggctggcctttgtacttag

SEQ ID NO: 16992 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16993 - DNA, 335 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcatcttccactccttcctcatcgtcccttactcaccattccaacactggctcactcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 16994 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacaacggcgagctttgctcaacgaccaccattccaacaccggctccctcgagagagacgaagtgtttgtccccaagaagaagtcagacatcaagtggtacggcaagtacctcaacaaccctttgggacgcacggtgatgttaaccgttcagttcacgctcggctggcctttgtacttag

SEQ ID NO: 16995 - DNA, 383 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaacgaacaggtcactatcagtcaaaataaaatcccgcgcgttggccgattcattaatgcagctggcacgacaggtttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 16996 - DNA, 447 bp, Artificial
  Mutation in BnaA.FAD2.a introduced by TALE nuclease pair BnFAD2_T02
cctctcctccctcaccctctctcctacttcgcctggcctctctactgggcctgcccgggctgcgtcctaaccggcgtctgggtcatagcccacgcgtgcggccaccacgccttcagcgactaccagtggctggacgacaccgtcggcctcatcttccactccttcctcctcgtcccttacttctcctggaagcaatgacattcttgcaggtatcttcgagccagccacgatcgacattgatctggctatcttgctgacaaaagcaagagaacatagcgttgcctcatcgacgccaccattccaacactggctccctcgagagagacgaagtgtttgtccccaagaagaagtcagacatcaagtggtacggcaagtaccgcaacaacccttagggatgcaccgtgatgttaccggttcagttcactctcggctggcctttgtacttag

SEQ ID NO: 16997 - DNA, 348 bp, Artificial
  Mutation in BnaA.FAD2.a introduced by TALE nuclease pair BnFAD2_T02
cctctcctccctcaccctctcccttacctcgcctgacccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccttcgacgccaccattccaacactggctccctcgatagagacgaagtgtttgtccccaagaagaagtcagacatcaagtggtacggcaagtacctcaacaaccctttgggacgcaccgtgatgttaacggttcagttcactctcggcgggcctttgtacttag

SEQ ID NO: 16998 - DNA, 357 bp, Artificial
  Mutation in BnaA.FAD2.a introduced by TALE nuclease pair BnFAD2_T02
cctctcctccctcaccctgtcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacacccctgtgggccgcgtcgtgatgttatcggttcagttcactctcggctggcctttgtacttag

SEQ ID NO: 16999 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctatgggtcatcgcccacgaatgcggccaccacgccttcagcgaccaccagtggctggacgacgccgtgggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 17000 - DNA, 359 bp, Artificial
  Mutation in BnaA.FAD2.a introduced by TALE nuclease pair BnFAD2_T02
cctctcctccctcaccctctctcctacttcgcctggcatctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 17001 - DNA, 356 bp, Artificial
  Mutation in BnaA.FAD2.a introduced by TALE nuclease pair BnFAD2_T02
cctctcctccctcactctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17002 - DNA, 415 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtagcgagtcagtgagcgaggaagcggaagagcgcccaatacgcaaaccgcctctcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17003 - DNA, 331 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggcttgacgacaccgtcggtctcatcttccactccttcctccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17004 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgtgacgcaccgtgatgttaacggttcagttcactctcggctggcctttgtacttag

SEQ ID NO: 17005 - DNA, 443 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgaggccaccacgccttcagcgactaccagtggcttgacgacaccgtcggtctcatcttccactccttcctcctcgtcccttacttctcctggaagcaggaggtggccatcgccaccaatggcggtggcaagcaggcgctggagacggtccagcgtctgtcgccggtgctgtgccaggcccagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 17006 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaagcctttgggacgcaccgtgatgttaacggttcagttcactctcggctggcctttgtacttag

SEQ ID NO: 17007 - DNA, 357 bp, Artificial
  Mutation in BnaA.FAD2.a introduced by TALE nuclease pair BnFAD2_T02
cctctcctccctcaccctgtctcctacttcgcctggcctctctactgggcctgccaagggcgcgtcctaaccggcgtctgggtcatagcccacgagtgcggccaccacgccttcagcgactaccagtggctggacgacgccgtgggcctcatcttccactccttcctcctcgtcccttacttctcctggaaagtcatcgacgccaccattccaacactggctccctcgagagagacgaagtgtttgtccccaagaagaagtcagacatcaagtggtacggcaggtacctcaacatccctttggaacgcaccgtgatgttaacggttcagttcactctcggctggcctttgtgcttag

SEQ ID NO: 17008 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 17009 - DNA, 293 bp, Artificial
  Mutation in BnaA.FAD2.a introduced by TALE nuclease pair BnFAD2_T02
cctctcctccctcaccctctctcctacttcgcctggcctctccactgggcctgccagggctgcgtcctaaccgccgtctgggtcatagcccacgagtgcggccaccacgccttcagcgactaccagtggctggacgacaccgtcggcctcatcttccactccttcctccttgtcaagtgtttgtccccaagaagaagtcagacatcaagtggtacggcaagtacctcaacaaccctttgggacgcaccgtgatgttaacggttcagttcactctcggatgcctttgtacttag

SEQ ID NO: 17010 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccatcatcgacgccaccattccaacactggctccctcgagagagacgaagtgtttgtccccaagaagaagtcagacatcaagtggtacggcaagtacctcaacaacccttagggacgcaccgtgatgttaacggttcagttcactctcggctggcctttgtacttag

SEQ ID NO: 17011 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 17012 - DNA, 389 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtacagcaacgtcggttcgagatggcgctcgaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17013 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtaagacatcaagtggtacggcaagtacctcaacaaccctttgggacgcaccgtgatgttaacggttcagttcactctcggctggcctttgtacttag

SEQ ID NO: 17014 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17015 - DNA, 357 bp, Artificial
  Mutation in BnaA.FAD2.a introduced by TALE nuclease pair BnFAD2_T02
cctctcctccctcaccctctatcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 17016 - DNA, 360 bp, Artificial
  Mutation in BnaA.FAD2.a introduced by TALE nuclease pair BnFAD2_T02
cctctcctccctcaccctctctcctacttcgcctggcctctctactcggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcactctcggctggcctttgtacttag

SEQ ID NO: 17017 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacagccctatgggaagaagcgtgaggttaagggtccagttcactctcggctggccatagtacttag

SEQ ID NO: 17018 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaatatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17019 - DNA, 357 bp, Artificial
  Mutation in BnaA.FAD2.a introduced by TALE nuclease pair BnFAD2_T02
cctctcctccctcaccctctcccctacctcgcctggcccctctactgggcctgccaaggctgcgtcctaaccggcctctgggtcatcgcccacgaatgcggccaccacgccttcagcgaccaccagtggctggacgacaccgtcggcctcgtcttccactccttcctcctcgtcccttacttctcctggaaggtcatcgacgccaccattccaacactggctccctcgagagagacgaagtgtttgtccccaagaagaaatcccacatcaagtggtacggcaagtacctcaacaacccgttgggacgcaccgtgatgttaaccgttcagttcacgctcggctggcctttgtacttag

SEQ ID NO: 17020 - DNA, 357 bp, Artificial
  Mutation in BnaA.FAD2.a introduced by TALE nuclease pair BnFAD2_T02
cctctcctccctcaccctctcccttacctcgcctgccccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17021 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17022 - DNA, 363 bp, Artificial
  Mutation in BnaA.FAD2.a introduced by TALE nuclease pair BnFAD2_T02
cctctcctccctccccctctctcctacttcgcctggcctctctactgggcctgccaagggtgcgtcctaaccggcgtctgggtcaaagcccacgagtgcggccaccacgccttcagcgactaccagtggctggacgacaccgtcggcctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17023 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17024 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatcatcgacgccaccattccaacactggctccctcgagagagactaagtgtttgcccccaagaagaaatcccacatcgagtggtacggaaagtacctcaacaacccgctaggccgcacggtgatgctaagcgtccagttcacgctaggctggccttagtacttag

SEQ ID NO: 17025 - DNA, 335 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttactcaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17026 - DNA, 344 bp, Artificial
  Mutation in BnaA.FAD2.a introduced by TALE nuclease pair BnFAD2_T02
cctctcctccctcaccctatctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttactcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17027 - DNA, 312 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcctcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 17028 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaacccgttgggacgcaccgtgatgttaacgtttcagtgcactctcggctggcctttgtacttag

SEQ ID NO: 17029 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17030 - DNA, 355 bp, Artificial
  Mutation in BnaA.FAD2.a introduced by TALE nuclease pair BnFAD2_T02
cctctcctccctcaccctttctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaaatccgacatcaagtggtacggaaagtacctcaacaaccggctaggacgcacggtgatgctaaccgtccaggtcacgctcggctgcccttggtacttag

SEQ ID NO: 17031 - DNA, 356 bp, Artificial
  Mutation in BnaA.FAD2.a introduced by TALE nuclease pair BnFAD2_T02
cctctctcccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17032 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaaaaagtcagactgcaggtggtacggcatgtaccacaacagccctttaagatgctccgtgatgataacggttcagttcactctctgctgacctttggactta

SEQ ID NO: 17033 - DNA, 454 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacgatgttccagattacgctatcgatatcgccgatctacgcacgctcggctacagccagcagcaacaggagaagatcaaaccgaaggttcgttcgagtcatcgacgccaccattccaacactggctccctcgagagagacgaagtgtttgtccccaagaagaagtcagacatcaagtggtacggcaagtacctcaacagccctttgtgacgcaccgtgatgtcaacggttcagttcactctcggctggccgttgtacttag

SEQ ID NO: 17034 - DNA, 411 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcctcttccactccttcctcctcgtcccttacttctcctggagtcttcatgaaggtgtacggctacaggggcaagcacctgggcggctccaggaagcagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 17035 - DNA, 355 bp, Artificial
  Mutation in BnaA.FAD2.a introduced by TALE nuclease pair BnFAD2_T02
cctctcctccctcaccctatctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17036 - DNA, 357 bp, Artificial
  Mutation in BnaA.FAD2.a introduced by TALE nuclease pair BnFAD2_T02
cctctcctccctcaccctgtcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaagctcatcgacgccaccattccaacactggctccctcgagagagacgaagtgtttgtccccaagaagacgtcagacctcaagtggtacggcaagtacctcaacaaccctttgggacgcaccgtgatgttaacggttcagttcactctcggctggcctttgtacttag

SEQ ID NO: 17037 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatcgacgccaccattccaacactggctccctcgagagagacgaagtgtttgtccccaagaagaagtcagacatcaagtggtacggcaagtacctcaacaaccctttgggacgcaccgtgatgttagcggttcagttcactctcggctggcctttgtacttag

SEQ ID NO: 17038 - DNA, 344 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttcctcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 17039 - DNA, 355 bp, Artificial
  Mutation in BnaA.FAD2.a introduced by TALE nuclease pair BnFAD2_T02
cctctcctccctcaccctatctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 17040 - DNA, 347 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17041 - DNA, 356 bp, Artificial
  Mutation in BnaA.FAD2.a introduced by TALE nuclease pair BnFAD2_T02
cctctcctccctcaccctctctcctacttcgcctgacctctctactgcgcctgccaagggtgcgtcctaaacggcgtctgggtcatagcccacgagtgcggccaccacgccttcagcgactaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggcaagtgcctgaacagccctatgtgacgcagagtgaggttcaggtgccagtgtactctcggctggcatgagtacttag

SEQ ID NO: 17042 - DNA, 427 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctccagcgcctgcttgccaccattattgctggcgatggccaccacctgctggggggtcaagccgtgggcctggcacagcaccggacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17043 - DNA, 378 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatatggcggcaagcaggcgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17044 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttgtacttag

SEQ ID NO: 17045 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcgagtggtacggcgagtacctcaacaaccgtttgggacgcaccgtgatgttaacgtttcggttcacgctcggctggcctgtgtacttag

SEQ ID NO: 17046 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17047 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttcacgacaccgtcggtctcatcttccactccttcctcctcgtaccttacttctcctggaagtcatcgacgccaccattccaacactggctccctcgagagagactaagtgtttgtcccccagaagcagtcagacatcgagtggtacggcaagtacctcaacagccctctgggacgcaccgtgatgttaacggttcagttgactctcggctggccttagtacttag

SEQ ID NO: 17048 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacgtag

SEQ ID NO: 17049 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 17050 - DNA, 353 bp, Artificial
  Mutation in BnaA.FAD2.a introduced by TALE nuclease pair BnFAD2_T02
cctctcctccctcaccctgtcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17051 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagttgcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17052 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 17053 - DNA, 355 bp, Artificial
  Mutation in BnaA.FAD2.a introduced by TALE nuclease pair BnFAD2_T02
cctctcctccctcaccctctcacttacctcgcctggcacctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17054 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 17055 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgccctaaagggcctctgggtcatcgcgcacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagttcctcaacaaccttctgggacgcaccgtgatgttaacggttcagttcactctcggctggcctttgtacttag

SEQ ID NO: 17056 - DNA, 356 bp, Artificial
  Mutation in BnaA.FAD2.a introduced by TALE nuclease pair BnFAD2_T02
cctctcctccctcaccctgtctcctacttcgcctggcctctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacatccctttgggacgcaccgtgatgttaacggttcaggtcacgctcggctggcctttgtacttag

SEQ ID NO: 17057 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttatttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17058 - DNA, 350 bp, Artificial
  Mutation in BnaA.FAD2.a introduced by TALE nuclease pair BnFAD2_T02
cctctcctccctcaccctctctcctacttcgcctgccctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 17059 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaatcatcgacgccaccattccaacactggctccctcgagagagacgaagtgtttgtctccaagaagaagtcagacatcaagtggtacggcaagtacctcaacaaccctttgggacgcaccgtgatgttaacggttcagttcactctcggctggcctttgtacttag

SEQ ID NO: 17060 - DNA, 419 bp, Artificial
  Mutation in BnaA.FAD2.a introduced by TALE nuclease pair BnFAD2_T02
cctctcctccctcaccctctctcctacttcgcctggcctctctacttggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggatctccagcggctgttgccggtgctgtgccaggcccacggcttgacccctcagcaggtggtggcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17061 - DNA, 442 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgagtgcggccaccacgccttcagcgactaccagtggctggacgacaccgtcggcctcgtcttccactccttcctcctcgtcccttacttctcctggaagtacaggtccttccatccaagctgggctgcctgcacgaaccccccgttcagcctcctacagcgcgcagaatcccgctcgctccacagtcatcgacgccaccattccaacaccggctccctcgagagagacgaagtgtttgtccccaagaagaagtcagacatcaagtggtacggcaagtacctcaacaaccctttgggacgcacggtgatgctaaccgttcagttcacgctcggctggcctttgtacttag

SEQ ID NO: 17062 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaccactggctccctcgagagagacgaagtgtttgtccccaagaagaagtcagacatcaagtggtacggcaagtacctcaacaaccctttgggacgcaccgtgatgttaacggttcagttcactctcggctggccttgtacttag

SEQ ID NO: 17063 - DNA, 388 bp, Artificial
  Mutation in BnaA.FAD2.a introduced by TALE nuclease pair BnFAD2_T02
cctctcctccctcaccctgtctcctacttcgcctggcctctctactgggcctgccagggctgcgtcctaaccggcgtctgggtcatagcccacgagtgcggccaccacgccttcagcgactaccagtggctggacgacaccgtcggcctcctcttccactccttcctcctcgtcccttacttctcctggaggcctttttacggttcctgtccttttgcgtacagtcatcgacgcctccattccaacactggctccctcgagagagacgaagtgtttgtccccaataagaagtcagacctcaagtggtacggcgagtacctcgacatccgtttggaacgcaccgtggggttaaccgtacagttcactctcggctggcctttgtgcttag

SEQ ID NO: 17064 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17065 - DNA, 356 bp, Artificial
  Mutation in BnaA.FAD2.a introduced by TALE nuclease pair BnFAD2_T02
cctctcctccctcaccctgtcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17066 - DNA, 367 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacacacacagtcatcgacgccaccattccaacactggctccctctagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17067 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgcctgcagcgacgaccagtggctggacaacaccgtcggcctcctctaccactccttcctcctcgtcccttacttctccttgtcatcgacgccaccattccaacactggctccctcgagagagacgaagtgtttgtccccaagaagaagtcagacatcgagtggtacggcaagtacctcaacaaccctttgggacgcactgtgatgttaacggttcaggtcactcgcggctggcctttgtacttag

SEQ ID NO: 17068 - DNA, 356 bp, Artificial
  Mutation in BnaA.FAD2.a introduced by TALE nuclease pair BnFAD2_T02
cctctcctccctcaccctgtctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtaatgttaacagttcagttcactctcggctggcctttgtacttag

SEQ ID NO: 17069 - DNA, 290 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgccaccattccaacactggctccctcgagagagacgaagtgtttgtccccaagaagaagtcagacatcaagtggtacggcaagtacctaacaaccctttgggacgcaccgtgatgttaacggttcagttcactctcggctggcctttgtacttag

SEQ ID NO: 17070 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaataagaagtcagacatcaagtggtacggcaagtacctcaacaaccctttgggacgcaccgtgatgttaacggttcagttcactctcggctggcctttgtacttag

SEQ ID NO: 17071 - DNA, 318 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17072 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgagacgcaccgtgatgtaaacggttcagttcactctcggctggcctttgtgctgag

SEQ ID NO: 17073 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgtccacgaatgcggccaccacgccttcagcgaccaccagtggctggacgacgccgtgggcctcgtcttccactccttcctcctcgtcccttacttctcctggaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17074 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccatggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccagcattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 17075 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctagccatcgacgccaccattccaacaccggatccctcgagagggatgaagtgttcgtccccaagaagaagtcagacatcaagtggtactgcaagtacctcaacaaccctttgggacgcaccgtgatgttaacggttcagttcactctcggctggcctttgtacttag

SEQ ID NO: 17076 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggctggcctttgtacttag

SEQ ID NO: 17077 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17078 - DNA, 348 bp, Artificial
  Mutation in BnaA.FAD2.a introduced by TALE nuclease pair BnFAD2_T02
cctctcctccctcaccctctctcctacttcgcctggactctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttagtcatcgacgccaccattccaacactggctccctcgagagagacgaagtgtttgtccccaagaagaagtcagacatcaagtggtacggcaagtacctcaacaaccctttggtacgcaccgtgatgttaacggttcatttccctcgcggctggcctttgtacttag

SEQ ID NO: 17079 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagacaccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 17080 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 17081 - DNA, 357 bp, Artificial
  Mutation in BnaA.FAD2.a introduced by TALE nuclease pair BnFAD2_T02
cctctcctccctcaccctctctcctacttcgcctcgcctctctactgggcctgccagggctgcgtcctaaccggcgtctgggtcatagcccacgagtgcggccaccacgccttcagcgactaccagtggctggacgacaccgtcggcctcctcttccactccttcctcctcgtcccttacttctcctggaaggtcatcgacgccaccattccaacaccggatccctcgagagggatgaagtgttcgtccccaagaaaaaatccgacatcaagtggtacggcaagtacctgaacaaccctttgggacgcaccgtgatgttaacggttcagttcacgctcggctggccgttgtacttag

SEQ ID NO: 17082 - DNA, 413 bp, Artificial
  Mutation in BnaA.FAD2.a introduced by TALE nuclease pair BnFAD2_T02
cctctactccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacaatggccaccacctgctggggggtcaagccgtgggcctggcacagcaccggcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttat

SEQ ID NO: 17083 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacatccctttgggacgcaccgtgatgttaacggttcagttcactctcggctggcctttgtacttag

SEQ ID NO: 17084 - DNA, 347 bp, Artificial
  Mutation in BnaA.FAD2.a introduced by TALE nuclease pair BnFAD2_T02
cctctcctccctcaccctctctcctacttcgccttgcctctctactgggcctgccagggctgcgccctaaccggcgtctgggtcatagcccacgagtgcggccaccacgccttcagcgactaccagtggctggacgacaccgtcggcctcatcttccactccttcctcctcgtcccttacttctcatcgacgccaccattccaacactggctccctcgagagagacgaagtgtttgtccccaagaagaagtcagacaccgagtggtacggcaagtacctcaacaacactttgggacgcaccatgatgttaacggttcagttcactctcggctggcctttgtacttag

SEQ ID NO: 17085 - DNA, 356 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccatcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 17086 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggagccatcgacgccaccattccaacaccggatccctcgagagggatgaagtgttcgtccccaagaagaaatccgacatcaagtggtacggaaagtacctcaacaacccgctaggacgcacggtgatgttaacggttcagttcactctcggctggcctttgtacttag

SEQ ID NO: 17087 - DNA, 357 bp, Artificial
  Mutation in BnaA.FAD2.a introduced by TALE nuclease pair BnFAD2_T02
cctctcctccctcaccctctcacttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccgttgggacgcaccgtgatgttaacggtgcaggtcactctcggctggcctgtgtacttag

SEQ ID NO: 17088 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaaatccgacatcaagtggtacggcaagtacctcaacaaccctttgggacgcaccgtgatgttaacggttcagttcactctcggctggcctttgtacttag

SEQ ID NO: 17089 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17090 - DNA, 391 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcatcttccactccttccaccaccagcaatattggtggcaagcaggcgctggagacagccatcgacgccaccattccaacaccggatccctcgagagggatgaagtgttcgtccccaagaagaaatccgacatcaagtggtacggaaagtacctcaacaacccgctaggacgcacggtgatgttaacggttcagttcactctcggctggcctttgtacttag

SEQ ID NO: 17091 - DNA, 332 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaactggctccctcgagagagacgaagtgtttgtgcccaagaagaaatccgacatcaagtggtacggaaagtacctcaacaacccgctaggacgcacggtgatgctaaccgtccagttcacgctcggctggcctttgtacttag

SEQ ID NO: 17092 - DNA, 356 bp, Artificial
  Mutation in BnaA.FAD2.a introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17093 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaacatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 17094 - DNA, 363 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaagtatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17095 - DNA, 346 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttccatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 17096 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctcgacgacaccgtcggcctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17097 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagccagacgtcaagtggtacggcaagtacctcaacaaccctttgggacgcaccgtgatgttaacggttcagttcacgctcggctggcctttgtacttag

SEQ ID NO: 17098 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccctttgtacttag

SEQ ID NO: 17099 - DNA, 417 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccccgccttcagcgaccaccagtggctggacgacgccgtgggcctcgtcttccactccttcctcctcgtcccttacggctccagcggctgtcgccggtgctgtgccaggcccacggcttgaccccggagcaggtggtggccatcgccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17100 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgactaccagtggcttgacgacaccgtcggtctcatcttccactccttcctcctcgtcccttacttctcctggcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17101 - DNA, 345 bp, Artificial
  Mutation in BnaA.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtacattccaacactggctccctcgagagagacgaagtgtttgtccccaagaagaagtcagacatcaagtggtacggcaagtacctcaacaaccctttgggacgcaccgtgatgttaacggttcagttcactctcggatggcctttgtacttag

SEQ ID NO: 17102 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctccttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17103 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 17104 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgttcgtccccaagaagaagtcagacatcaagtggtacggcaagtacctcaacaaccctttgggactcaccgtgatgttaacatttcagtgcactctcggctggcctgtgtacttag

SEQ ID NO: 17105 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacgccgtgggcctcgtcttccactccttcctcctcgtcccttacttctcctgaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17106 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacactggctccctcgagagagacgaagtgtttgtccccaagaagaagtcacacatcgagtggtacggcaagtacctcaacaaccctttgggacgcaccgtgaggttaacggttcagttcactctcggctggcctttgtacttag

SEQ ID NO: 17107 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttaactctcggctggcctttgtacttag

SEQ ID NO: 17108 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgaatgcggccaccacgccttcagcgaccaccagtggctggacgacgccgtgggcctcgtcttccactccttcctcctcgtcccttgcttctcctggaaggccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17109 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtacagtcatcgacgccaccattccaacactggctccctcgagagatacgaagtgtttgtccccaagaagaagtcagacatcaagtggtacggcaagtacctcaacatccctttgggacgcaccgtgatgttaacggttcagttcactctcggctggcctttgtacttag

SEQ ID NO: 17110 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccggagtgttaacggttcagttcgctctcggctgccctttgtacgtag

SEQ ID NO: 17111 - DNA, 357 bp, Artificial
  Mutation in BnaA.FAD2.a introduced by TALE nuclease pair BnFAD2_T02
cctctcctccctcaccctctctcctacttcgcctggccacactactgggcctcccagggctgcgtcctaaccggcgtctgggtcatcgcccacgagtgcggccaccacgccttcagcgactaccagtggctggacgacaccgtcggcctcatcttccactccttactcctcgtcccttacttctcctggaaggtcatcgacgccaccattccaacactggctccctcgagagagacgaagtgtttgtccccaagaagaagtcagacatcaagtggtacggcaagtacctcaacaaccctgtggaacgcaccgggatgttaacggttcagttcactctcggctggcctttgtacttag

SEQ ID NO: 17112 - DNA, 360 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaaggcagtcatcgacgccaccattccaacactggctccctcgagagagacgaagtgtttgtccccaagaagaagtcagacatcaagtggtacggcaagtgcctcaacaaccctttgggacgcaccgtgatgttaacggttcagttcactctcggctggcctttgtacttag

SEQ ID NO: 17113 - DNA, 394 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccgctcgccatgcatgcactgcctccactgcggtagtcatcgacgccaccattccaacactggctccctcgagagagacgaagtgtttgtccccaagaagaagtcagacatcaagtcgtacggcaggtaccccaacaaccctttgggacgcaccgtgaggttaacggttcagttgactcgcggctggcctttgtacttag

SEQ ID NO: 17114 - DNA, 397 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaaatgcccgaggcatagactgtaccccaaaaaaacagtcataagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcgctctcggctggcctttgtacttag

SEQ ID NO: 17115 - DNA, 464 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagtgactaccagtggctggacgacaccgtcggcctcatcttccactccttcctcctcgtcccttacttctcctggaaggccttggtaggtccagcggcggagcaactctttgatccggttcctgaacaggagctatttgaggcctttttacggttcctggccttttgctggccttttgctcacatgtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 17116 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaaaggttcagttcactctcggctggcctttgtacttag

SEQ ID NO: 17117 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggtctcatcttccactccttcctcctcgtcccttacttctcctggaagatcgacgccaccattccaacactggctccctcgagagagacgaagtgtttgtccccaagatgaagtcagacatcaagtggtacggcaagtacctcaacaaccctgtgggacgcaccgtgatgttaacggttcagttcactctcggctggcctttgtacttag

SEQ ID NO: 17118 - DNA, 442 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacaggtcgttcgctccaagctgggctgtgtgcacgaaccccccgttcagccttctacagcgcggagaatcgcgctctctccacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 17119 - DNA, 329 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtaggcctcatcttccactaccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17120 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 17121 - DNA, 355 bp, Artificial
  Mutation in BnaA.FAD2.a introduced by TALE nuclease pair BnFAD2_T02
cctctcctccctcaccctctctcctacttcgcctggcctctctcctgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactag

SEQ ID NO: 17122 - DNA, 355 bp, Artificial
  Mutation in BnaA.FAD2.a introduced by TALE nuclease pair BnFAD2_T02
cctctcctccctcaccctctctcctacttcgcctggcatatctactgggcctgccaagggagcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaacccgctgggacgccccgggatgttaatggtgaagttcactttcggctggcctgtgtacgtag

SEQ ID NO: 17123 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 17124 - DNA, 389 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtctggcgccgtcgggcttcctggagccgcccagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17125 - DNA, 427 bp, Artificial
  Mutation in BnaA.FAD2.a introduced by TALE nuclease pair BnFAD2_T02
cctctcctccctcaccctctcccttacctcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacaaggcggtaatacggttatccacagaatcaggggataacgatatcgatgctgtccatgtgctgtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 17126 - DNA, 349 bp, Artificial
  Mutation in BnaA.FAD2.a introduced by TALE nuclease pair BnFAD2_T02
cctctcctccctcaccctctccattacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttccgtcatcgacgccaccattccaacactggctccctcgagagagacgaagtgtttgtccccaagaagaagtcagacatcaagtggtacggcgattacctcaacagccctgtgggacgcgccgtgatgttaacagttcagtgcactctcggctggcctgtgtacttag

SEQ ID NO: 17127 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17128 - DNA, 357 bp, Artificial
  Mutation in BnaA.FAD2.a introduced by TALE nuclease pair BnFAD2_T02
cctctcctccctcaccctctctcctacttcgccttgcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17129 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacagcccgctaggacgcacggtgaggctaaccgtccagttcacgctcggcgggcctgtgtacttag

SEQ ID NO: 17130 - DNA, 356 bp, Artificial
  Mutation in BnaA.FAD2.a introduced by TALE nuclease pair BnFAD2_T02
cctctcctcctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatgtcatcgacgccaccattccaacactggctccctcgagagagacgaagtgtttgtccccaagaagaagttagacatcaagtggtacggcaagtacctcaacaaccctttgggacgcaccgtgatgtgaacggttcagttcactctcggctggcctttgtacttag

SEQ ID NO: 17131 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcatcgacgccaccattccaacactggctccctcgagagagacgaagtgtttgtccccaagaagaagtcagacagcaagtggtacggcaagtacctcaacaagcgtctgggacgcaccgtgatgttaacggttcagttcactctcggctggcctttgtacttag

SEQ ID NO: 17132 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagggatgaagtgttcgtccccaagaagaaatccgacatcaagtggtacggaaagtacctcaacaacccgctaggacgcacggtgatgttaacggttcagttcactctcggctggcctttgtacttag

SEQ ID NO: 17133 - DNA, 357 bp, Artificial
  Mutation in BnaA.FAD2.a introduced by TALE nuclease pair BnFAD2_T02
cctctcctccctcaccctctctcctacatcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17134 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccatgtctgcgtcctaacaggcgtctgggtcatagcccacgagtgcgtccaccacgccttcagcgactaccagtggctggacgacaccgtcggcctcatcttccactccttcctcctcgtcccttacttctcctggaagtcatcgacgccaccattccaacactggctccctcgagagagacgaagtttttgtccccaagaagcagtcacacatcaagtgttccctcaagtacctcgccacccctgtgggacgcaccgtaatgttaacgtttcagttcactctcggctggcctttgtacttag

SEQ ID NO: 17135 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcatcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17136 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 17137 - DNA, 356 bp, Artificial
  Mutation in BnaA.FAD2.a introduced by TALE nuclease pair BnFAD2_T02
cctctcctccctcaccctctctcctacttcgcctggcctctctactgggcctcccagggctgcgcccaaaccggcgtctggtccttagcccacgagtgcggccaccacgccttcagcgactaccagtggcttgacgacaccgtcggcctcatcttccactccttcctccccgtcccttacttctcctggaagtcatcgacgccaccattccaacactggctccctcgagagagacgaagtgtttgtccccaagaagaagtcagacatcaagtggtacggcaagtacctcaacatccctttgggacgcaccgtgatgttaacggttcagttcactctcggctggcctttgtacttag

SEQ ID NO: 17138 - DNA, 356 bp, Artificial
  Mutation in BnaA.FAD2.a introduced by TALE nuclease pair BnFAD2_T02
cctctcctccctcaccctctctcctacttcgcctggtctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17139 - DNA, 355 bp, Artificial
  Mutation in BnaA.FAD2.a introduced by TALE nuclease pair BnFAD2_T02
cctctcttccctcaccctctctcctacttcgcctggcctctctactgggcctgccagggctgcgtcctaaccggcgtctgggtcatagcccacgagtgcggccaccacgccctcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacacccctttgggacgcaccgtgatgttaacggttcagttcactctcggctggcctttgtacttag

SEQ ID NO: 17140 - DNA, 291 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 17141 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagtcatcgacgccaccattccaacactggctccctcgagagagacgaagtgtttgtccccaagaagaagtcaggcatcaagtggtacggcaagtacctcaacaacccgctaggacgcacggtgatgctaaccgtacagttcacgctcggatggcctttgtacttag

SEQ ID NO: 17142 - DNA, 357 bp, Artificial
  Mutation in BnaA.FAD2.a introduced by TALE nuclease pair BnFAD2_T02
cctctcctccctcaccctctctcctacttcgcatggcgtctctactgggcctgccagggctgcgtcctaaccggcgtctgggtcatagcccacgagtgcggccaccacgccttcagcgactaccagtggctggacgccaccgtcggcctcatcttccactccttcctcctcgtcccttacttctcctggaagatcatcgacgccaccattccaacactggctccctcgagagagacgaagtgtttgtccccaagaagaagtcagacatcaagtgggacgccaatcacctcaacagtcctttgtgtctcacagtgatgttaacggttcagttcactctcggctggcctttgcacttag

SEQ ID NO: 17143 - DNA, 387 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctgggcctggcacagcaccggcaacagccgctggacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 17144 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17145 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcatgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17146 - DNA, 347 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17147 - DNA, 356 bp, Artificial
  Mutation in BnaA.FAD2.a introduced by TALE nuclease pair BnFAD2_T02
cctctcctcctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 17148 - DNA, 356 bp, Artificial
  Mutation in BnaA.FAD2.a introduced by TALE nuclease pair BnFAD2_T02
cctctcctccctcaccctctctcctacttcgcctggcctctctactgggcatgccagggctgcgtcctaaccggcgtctgggtcatagcccacgagtgcggccaccacgccttcagcgactaccagtggctggacgacaccttcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17149 - DNA, 354 bp, Artificial
  Mutation in BnaA.FAD2.a introduced by TALE nuclease pair BnFAD2_T02
cctctcctcctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17150 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcgtccaccacgccttcagcgactaccagtggctggacgacaccgtcggcctcatcttccactccttcctcctcgtcccttacttctcctggaagtcatcgacgccaccattccaacaccggatccctcgagagggatgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 17151 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcatcgacgccaccattctaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17152 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtaccgcaacaaccctttgggacgcaccgtgatgttaacggttcagttcgctctcgggtggcctttgtacttag

SEQ ID NO: 17153 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggctggacgacaccgtcggcctcatcttccactccttcctcctcgtcccttacttctcctggaagagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 17154 - DNA, 387 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtccctttgcctggcacagcaccggcaacagccgctggaccgtctccagctgtcatcgacgcaaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17155 - DNA, 355 bp, Artificial
  Mutation in BnaA.FAD2.a introduced by TALE nuclease pair BnFAD2_T02
cctctcctccctcaccctctctcctacttcgcctggcctctcttctggtcctgccaagggtgcgtccgaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgttgtccccaagaagaagtcagacataaagtggtacggcaagttcctcaacaaccctttggtatgcatagtaatgttacccgtcccgctcactctcggctggcctttgtacttag

SEQ ID NO: 17156 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtgttacggcaagtacctcaacaaccctttgggacgcaccgtgatgttaacggttcagttcactctcggctggcctttgtacttag

SEQ ID NO: 17157 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 17158 - DNA, 312 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcgacgccaccattccaacactggctccctcgagagagacgaagtgtttgtccccaagaagaagtcagacatcaagtggtacggcaagtacctcaacaacccgttgggacgcaccgtgatgttaacggttcagttcacgctcggctggcctttgtacttag

SEQ ID NO: 17159 - DNA, 378 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatatggcggcaagcaggcgctggagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 17160 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagctactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 17161 - DNA, 393 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgccggcctcatcttccactccttcctcctcgtcccttacttctcctggaagtacaacactggctccctcgagagagacgaagtgtttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17162 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcttgcctttgtacttag

SEQ ID NO: 17163 - DNA, 422 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtacggcttgaccccggagcaggtggtggccatcgccagccacgctggcggcaagcaggcgctggagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 17164 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacagccctgtgggacgcaccgtgaggttaacggttcagttcactctcggctggcctttgtacttag

SEQ ID NO: 17165 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagtcatcgacgccaccattccaacactggcgccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17166 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctccttgtcatcgacgccaccattccaacactggctccctcgagagagacgaagtgtttgtccccaagaagaagtcagacatcaagtggtacggaaagtacctcaacaaccctttgggacgcaccgtgatgttaacggttcagttcactctcggctggcctttgtacttag

SEQ ID NO: 17167 - DNA, 386 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctggcacagcaccggcaacagccgctggaccgtctccgtgagcaaggcctccagagcgcgtgcgtcggcaaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17168 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 17169 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctctcagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17170 - DNA, 439 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtgccggtgctgtgccaggcccacggcttgaccccggagcaggtggtggccatcgccagccacgatggcggcaagcaggcgcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17171 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17172 - DNA, 357 bp, Artificial
  Mutation in BnaA.FAD2.a introduced by TALE nuclease pair BnFAD2_T02
cctctcctacctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17173 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17174 - DNA, 361 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtacaagtcatcgacgccaccattccaacactggctccctcgagagagacgaagtgtttgtccccaagaagaagtcagacatcaagtggtacggcaagtacctcaacaacccttgggacgcaccgtgatgttaacggttcagttcactctcggctggcctttgtacttag

SEQ ID NO: 17175 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgctttcagcgactaccagtggctggacgacaccgtcggcctcatcttccactccttcctcctcgtcccttacttctcctggaagtaccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 17176 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaaggacctcaacaaccctttggaacgccccgtgatgttaacggttcagttcactcgcggctggcctttgtacttag

SEQ ID NO: 17177 - DNA, 358 bp, Artificial
  Mutation in BnaA.FAD2.a introduced by TALE nuclease pair BnFAD2_T02
cctctcctccctcaccctctctcctacttcgcctggactctctactgggcctgccaagggtgcgtcctaaccggcgtctgggtcatagcccacgagtgcggccaccacgccttcagcgaccaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcgctctcggctggcctttgtacttag

SEQ ID NO: 17178 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcgaccaccacgccttcagcgactaccagtggctggacgacaccatcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtattag

SEQ ID NO: 17179 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 17180 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttaagttcactctcggctggcctttgtacttag

SEQ ID NO: 17181 - DNA, 441 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagctcggtttgatcgacagtggcgcagcaccacgaggcactggtcggccacgggtttacacacgcgcacatcgttgcgttaagccagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 17182 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagccatcgacgccaccattccaacaccggatccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 17183 - DNA, 342 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtccctgtcatcgacgccaccattccaacactggctccctcgagagagacgaagtgtttgtccccaagaagaagtcagacatcaagtggtacggcaagtacctcaacagccctttgggacgcaccgtgatgttaacggttcatttcactctcggctggcctttgtacttag

SEQ ID NO: 17184 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcgaccaccacgccttcagcgactaccagtggcttgacgacaccgtcggtctcatcttccactccgtcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17185 - DNA, 344 bp, Artificial
  Mutation in BnaA.FAD2.a introduced by TALE nuclease pair BnFAD2_T02
cctctcctccctcaccctctctcctacttcgcctggcctctctactgggcctgccaggggtgcgtcctaaccggcgtctgggtcatagcccacgagtgcggccaccacgccttcagcgactaccagtggctggacgacaccgtcggcctcatcttccactccttcctcctcgtcccttcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17186 - DNA, 428 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaagtggcgatggccaccacctgctggggggtcaagccgtgggcctggcacagcaccggcaacagccgctgggcagtcatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17187 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaaggacctcaacaaccctttgggacgcaccgtgatgttaacggttcagttcactctcggctggcctttgtacttag

SEQ ID NO: 17188 - DNA, 356 bp, Artificial
  Mutation in BnaA.FAD2.a introduced by TALE nuclease pair BnFAD2_T02
ctctcctccctcaccctctcccttacctcgcctggcccctctcctgcgcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctacctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17189 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17190 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcatcgacgccaccattccaacactggctccctcgagagagacgaagtgtttgtccccaagaagaagtcagacatcaagtggtacggcaagtacatcaacaaccatttgggacgcaccgtgatgttaacggttcagttcactctcggctggcctttgtacttag

SEQ ID NO: 17191 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17192 - DNA, 411 bp, Artificial
  Mutation in BnaA.FAD2.a introduced by TALE nuclease pair BnFAD2_T02
cctctcctccctcaccctctctcctacttcgccttgcttctttactgggcctgccagggctgcgtcctaaccgccgtctgggtcatcgcccacgagtgcggccaccacgccttcagcgactaccagtggctggacgacaccgtcggcctcatcttccactccttcctcctcgtcccttacttctcctggaagtacgcgtaccgctagccaggtagagtttgtagaaacgcaaaaaggccatccccagtcatcgacgcctccatgccaacacgggctccctcgagagagacgaagtgtttgtccccaagaagaagtcagacaacaagtggtacggcaattacctcaacaagcctgtgggacgcaccggactgttaacggttcagttcactctcggctggcctttgtacttag

SEQ ID NO: 17193 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtatgtccccaagaagaagtcagacatcaagtggtacggcaagtacctcaacaaccctttgggacgcaccgtgatgttaacggttcagttcactctcggctggcctttgtacttag

SEQ ID NO: 17194 - DNA, 332 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 17195 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaaggcagacatcaagtggtacggcaagtacctcaacaaccctttgggacgcaccgtgatgttaacggttcagttcactctcggctggcctttgtacttag

SEQ ID NO: 17196 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtacagtcatcgacgccaccattccaacactggctccctcgagagagacgaagtgtttgtccccaagaagaagtcagacatcaagtggtacggcaagtacctcaacaaccctttgggacgcaccgtgatgctaaccgtccagttcacgctcggctggcctttgtacttag

SEQ ID NO: 17197 - DNA, 401 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcgtcttccactccttcctcctcgtcccttacttctcctggaagtactgcccgctttccagtcgggaaacctgtcgtgccagctgcaagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17198 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccatcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17199 - DNA, 356 bp, Artificial
  Mutation in BnaA.FAD2.a introduced by TALE nuclease pair BnFAD2_T02
cctctcctccctcaccctctctcctacttcgcctggcatctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17200 - DNA, 365 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgaccaccagtggctggacgacgccgtgggcctcgtcttccactccttcctcctcgtcccttacttcctcctcgtcccttacttctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17201 - DNA, 352 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctggatcatcgcccacgaatgcggccaccacgccttcagcgaccaccagtggctggacgacgccgtgggcctcgtcttccactccttcctcctcgtcccttacttctcctggaagcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17202 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgaatgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17203 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgaccaccagtggctggacgacgccgtgggcctcgtcttccactccttcctcctcgtcccttacttctcctggaagccatcgacgccaccattccaacactggctccctcgagagagacgaagtgtttgtccccaagaagaagtcagacatcaagtggtacggcaagtacctcaacaaccctgtgggacgcaccgggatgttaacggttcagttcactctcggctggcctttgtacttag

SEQ ID NO: 17204 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacactggctccctcgagagagacgaagtgtttgtccccaagaagaagtcagacatcaagtggtacggcaagtacctcaacagcccgttgggacgcaccgggatgttaacggttcagttcactctcggctggccgttgtacttag

SEQ ID NO: 17205 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17206 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 17207 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcatcgactaccagtggctggacgacaccgtcggcctcatcttccactccttcctcctcgtcccttacttctcctggaagttgtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 17208 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacacctctgtgggacgcaccgtgatgttaacggttccgttcactctcggctggcctttgtacttag

SEQ ID NO: 17209 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17210 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttatccccaagaagaagtcagacatcaagtggtacggcaagtacctcaacaaccctttgggacgcaccgtgatgttaacggttcagttcactctcggctggcctttgtacttag

SEQ ID NO: 17211 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcgctctcggctggcctttgtacttag

SEQ ID NO: 17212 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaattacctcaacaaccctttgggacgcaccgtgatgttaacggttcagttcactctcggctggcctttgtacttag

SEQ ID NO: 17213 - DNA, 329 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactaccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 17214 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcatcttccactccttcctcctcgtcccttacttctcctggaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 17215 - DNA, 396 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctccccacggcttgaccccccagcaggtggtggccatcgccattctccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 17216 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgagtcctaaccggcgtctgggtcatagcccacgagggaggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaaatccgacaccaagtggtacggcaagtacctcaacatccatttgggacgcaccgtgatgtcaacggttcagttcactctcggctggcctttgtacttag

SEQ ID NO: 17217 - DNA, 365 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaactacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 17218 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacgtag

SEQ ID NO: 17219 - DNA, 451 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtgcatgcatggcgcaatgcactgacgggtgccccgctcaacttgaccccaagattgcaaaacgtggcggcgtgaccgcagtggaggcagtgcatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17220 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacacagtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17221 - DNA, 397 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccagcggtggtttgtttgccggaaaaagagttggtacagtcatcgacgccaccattccaacaccggatccctcgagagggatgaagtgttcgtccccaagaagaaatccgacatcaagtggtacggaaagtacctcaacatcccgctaggacgcacggtgatgctaaccgtccagttcacgctcggctggcctttgtacttag

SEQ ID NO: 17222 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcaccgtgatgttaacggttcagttcactctcggctggcctttgtacttag

SEQ ID NO: 17223 - DNA, 389 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacagcaacgtcggttcgagatggcgctcgaagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 17224 - DNA, 450 bp, Artificial
  Mutation in BnaA.FAD2.a introduced by TALE nuclease pair BnFAD2_T02
cctctcctccctcaccctctctactacttcgcctggcctctctactgggcctgccaaggctgcgtcctaacgggcctctgggtcatcgcccacgaatgcggccaccacaccttcagcgaccaccagtggctggacgacgccgtgggcctcgtcttccactccttcctcctcgtcccttacttctcctggaagctgctggagacggtccagcggctgttgccggtgctgtgccaggcccacggcttgaccccccagcaggtggtggccatcgccagcaataatgtagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 17225 - DNA, 306 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcatcgacgccaccattccaacactggctccctcgagagagacgaagtgtttgtccccaagaagaagtcagacatcaagtggtacggcaagtacctcaacaaccctttgggacgcaccgtgatgttaacagttcagttcactctcggctggcctttgtacttag

SEQ ID NO: 17226 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctgtcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 17227 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaattacctcaacaaccctttgggacgcaccgtgatgttaacggttcatttctctctcggctggcctttgtacttag

SEQ ID NO: 17228 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17229 - DNA, 391 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtgtaggtcgttcgctccaagctgggctgtgtgcacgaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17230 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccacgaagaaggcagacatcaagtggtacggcaagtacctcaacaaccctctgggacgcaccgtgatgttaacggttcagttcactctcggctggcctttgtacttag

SEQ ID NO: 17231 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 17232 - DNA, 291 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17233 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttacagtcaccgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17234 - DNA, 356 bp, Artificial
  Mutation in BnaA.FAD2.a introduced by TALE nuclease pair BnFAD2_T02
cctctcctccctcaccctctcacttacctcgcctggcaactctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcaacgccaccattccaacactggctccctcgagagagacgaggtgtttgtccccaagaagaaggcagacatcaagtggtacgacaaatacctcaacaacccgttggaacgccccgggatgttaacggttcatttcactctcggctggcctttgtacttag

SEQ ID NO: 17235 - DNA, 394 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaagtattgagtgagctgataccgctcgccgcagccgaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17236 - DNA, 364 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaagttacacagtcatcgacgccaccattccaacactggctccctcgagagagacgaagtgtttgtccccaagaagaagtcagacatcaagttgtacggcaagtacctcaacaaccctttgggacgcaccgtgatgttaacggttcagttcactctcggctggcctttgtacttag

SEQ ID NO: 17237 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 17238 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcatgctcggctggcctttgtacttag

SEQ ID NO: 17239 - DNA, 358 bp, Artificial
  Mutation in BnaA.FAD2.a introduced by TALE nuclease pair BnFAD2_T02
ctctctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaggcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17240 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggaaagtacctcaacaacccgctaggacgcacggtgatgctaacggttcagttcactctcggctggcctttgtacttag

SEQ ID NO: 17241 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17242 - DNA, 345 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctacgccaccattccaacaccggatccctcgagagggatgaagtgtttgtccccaagaagaagtcagacatcaagtggtacggcaagtacctcaacaaccctttgggacgcaccgtgatgttatcggttcagttcactctcggcttgcctttgtacttag

SEQ ID NO: 17243 - DNA, 422 bp, Artificial
  Mutation in BnaA.FAD2.a introduced by TALE nuclease pair BnFAD2_T02
cctctcctccccaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttactttccagcgcctgcttgccgccatcgtggctggcgatggccaccacctgctgggggggcaagccgtgggcctggcacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17244 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaactaccccaacacccctttgggacgcaccgtgaggttaacggtgcaagtcactctcggctggcctttgtacttag

SEQ ID NO: 17245 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaggaagtcagacatcaagtggtacggcaagtacctcaacaacccgctaggacgcacggtgatgctaaccgtccagttcacgctcggctggcctttgtacttag

SEQ ID NO: 17246 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctccttgtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 17247 - DNA, 351 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17248 - DNA, 291 bp, Artificial
  Mutation in BnaA.FAD2.a introduced by TALE nuclease pair BnFAD2_T02
cctctcctctctcaccctctctcctacttcgcctggcctctctactgggcctgccagggctgcgtcctaaccggcgtctgggtcatagcccacgagtgcggccaccacgccttcagcgactaccagtggctggacgacaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17249 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcgtcttccactccttcctcctcgtcccttacttctcctggaaagtggctccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 17250 - DNA, 356 bp, Artificial
  Mutation in BnaA.FAD2.a introduced by TALE nuclease pair BnFAD2_T02
cctctcctccctcaccctctcccttacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17251 - DNA, 345 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcttcccttacttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17252 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacacccctgtgggacgcaccgtgatgttaacggttccgttcactctcggctggcctttgtacttag

SEQ ID NO: 17253 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacagccctttgggacgcaccgtgatgttaacggttcagtgctctctcggctggcctttgtacttag

SEQ ID NO: 17254 - DNA, 382 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgactaccagtggctggacgacaccgtcggcctgggtcaagttgagcggggcacccgtcagtgcattgcgccatgcaggcggcaagcaggcgctggagacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcgctctcggctggcctttgtacttag

SEQ ID NO: 17255 - DNA, 346 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagtgactaccagtggctggacgacaccgtcggcctcatcttccactccttcctcctcgtcccttacttctcctggagccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17256 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 17257 - DNA, 353 bp, Artificial
  Mutation in BnaA.FAD2.a introduced by TALE nuclease pair BnFAD2_T02
cctctcctccctcaccctctcccctacttcgcctcgcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacatcgacgccaccattccaacactggctccctcgagagagacgaagtgtttgtccccaagaagaagtcagacatcaagtggtacggcaagtacctcaacagcccttgggggcgcaccgtgatgttaacggttcagttcactctcggctggcctttgtacttag

SEQ ID NO: 17258 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17259 - DNA, 291 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccattccaacactggctccctcgagagagacgaagtgtttgtccacaagaagaagtcagacatcaagtggtacggcaagtacctcaacaaccctttgggacgcaccgtgatgttaacggttcagttcactctcggctggcctttgtacttag

SEQ ID NO: 17260 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtgcggcaagtacctcaacaaccctttgggacgcaccgtgatgttaacggttcagttcactctcggctggcctttgtacttag

SEQ ID NO: 17261 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcatcgacgccatcattccaacactggctacctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17262 - DNA, 335 bp, Artificial
  Mutation in BnaA.FAD2.a introduced by TALE nuclease pair BnFAD2_T02
cctctcctccctcaccctctctcctacttcgcctggcctctctactgggactgccaagggtgcgtcctaaccggcgtctgggtcatagcccacgagtgcggccaccacgccttcagcgaccaccagtggctggacgacaccgtcggcctcatcttccactccttcctcctcgtcccttactcaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17263 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacgccgtgggcctcgtcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17264 - DNA, 389 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgccccttacttctcctggaagtacagcaacgacggttcgagatggcgcgcgaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17265 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaaacccgacatcaagtggtgcggaaagtacctcaacaacccgctaggacgcacggtgatgctaaccgtccagttcacgctcggctggcctttgtacttag

SEQ ID NO: 17266 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtacagtcatcgacgccaccattccaacactggctccctcgagagagacgaagtgtttgtccccaagaagaagtcagacatcaagtggtacggcaagtacctcaacaaccctttgggacgcaccttgatgttaacggttcagttcactctcggctggcctttgtccttag

SEQ ID NO: 17267 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagggatgaagtgttcgtccccaagaagaaatccgacatcaagtggttcggaaagtccctcaacaccccgctaggacgcacggtgatgctaaccgtccagttcccgctcggctggcctttgtacttag

SEQ ID NO: 17268 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctctagagagacgaagtgtttgtccccaagaagaagtcagacatcgagtggtacggcaagtacctcaacaaccctttgggacgcaccgtgatgttaacggttcagttcactctcggctggcctttgtacttag

SEQ ID NO: 17269 - DNA, 349 bp, Artificial
  Mutation in BnaA.FAD2.a introduced by TALE nuclease pair BnFAD2_T02
cctctcctccctcaccctctctcctacttcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17270 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 17271 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 17272 - DNA, 347 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttatccatgacgccaccattccaacaccggatccctcgagagggatgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 17273 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactccagtggctggacgacaccgtcggcctcatcttccactccttcctcctcgtcccttacttctcctggtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 17274 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatcgacgccaccattccaacactggctccctcgagagagacgaagtgtttgtccccaagaagaagtcagacatcaagtggtacggcaagtacctcaacatccctttgggacgcaccgtgatgttaacggttcagttcacgctcggctggcctttgtacttag

SEQ ID NO: 17275 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttgtacttag

SEQ ID NO: 17276 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggtcgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17277 - DNA, 365 bp, Artificial
  Mutation in BnaA.FAD2.a introduced by TALE nuclease pair BnFAD2_T02
ctctcctccctcaccctctctcctacttcgcctggcccctctactgggcctgccaaggctgcgtcctaacgggcctctgcgtcatcgcccacgaatgcggccaccacgccttcagcgactaccagtggctggacgacaccgtcggcctcatcttccactccttcctcctcgtcccttacaatcagaaaaggtccactgggttcgtgccttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17278 - DNA, 356 bp, Artificial
  Mutation in BnaA.FAD2.a introduced by TALE nuclease pair BnFAD2_T02
cctctcatccctcaccctctctcctacttcgccttgcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17279 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17280 - DNA, 319 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17281 - DNA, 462 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccgtctccagcgcctgcttgccgccaccgtggctggcgagggccaccacctgctccggggtcaagccgtgggcctggcacagcaccggcaacagccgctggaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 17282 - DNA, 349 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctatcgacgccaccattccaacactggctccctcgagagagacgaagtgtttgtccccaagaagaagtcagacatcaagtggtacggcaagtacctcaacaacccttggggacgcaccgggatgttaacggttcagttccctctcggctggcctttgtacttag

SEQ ID NO: 17283 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 17284 - DNA, 391 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagtgtaggtcgttcgctccaagctgggctgtgtgcacgaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17285 - DNA, 370 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaagtaagaaaaatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17286 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 17287 - DNA, 344 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttactcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 17288 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggatgtcatcgacgccaccattccaacactggctccctcgagagagacgaagtgtttgtccccaagaagaagtcagacatcaagtggtacggcaagtacctcaacatccctttgggacgccccgtgatgtaaacggttcagttcacgctcggctggcctttgtgcttag

SEQ ID NO: 17289 - DNA, 388 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaggcctttttacggttcctggccttttgcgtacagccatcgacgccaccattccaacaccggatccctcgagagagacgaagtgtttgtccccaagaagaagtcagacatcaagtggtacggcaagtacctcaacaaccctttggagcgcaccgtgatgttaacggttcagttcactctcggctggcctttgtacttag

SEQ ID NO: 17290 - DNA, 356 bp, Artificial
  Mutation in BnaA.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaactcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactgag

SEQ ID NO: 17291 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggcatcgacaccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 17292 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcatcatcttccactccttccgcctcgtcccttacttctcctggagagtcatcgacgccaccattccaacactggctccctcgagagagacgaagtgtttgtccccaagaagaagtcagacatcaagtggtacggcaagtacctcaacaaccctttgggacgcaccgagatgttaacggttcagttcactcgcggctggcatttgtacttag

SEQ ID NO: 17293 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17294 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgactaccagtggcttgacgacaccgtcggtctcatcttccactccttcctcctcgtcccttacttctccagtcatcgacgccaccattccaacactggctccctcgagagagacgaagtgttcgtccccaagaagaagtcatacatcaagtggtacggcaagtacctcaacaaccctttgggacgcaccgtgatgttaacggttcagttcactctcggctggcctttgtacttag

SEQ ID NO: 17295 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatcgcccacgaatgcggccaccacgccttcagcgaccaccagtggctggacgacgccgtgggcctcgtcttccactccttcctcctcgtcccttacttctcctggaaccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17296 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 17297 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggccttagtacttag

SEQ ID NO: 17298 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcctctgggtcatcgcccacgaatgcggccaccacgccttcagcgactaccagtggcttgacgacaccgtcggtctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 17299 - DNA, 312 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17300 - DNA, 343 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtactta

SEQ ID NO: 17301 - DNA, 435 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtacaacgaacaggtcactatcagtcaaaataaaatcattatttgccatgtcggttcgagatggcgctcgatgacgccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17302 - DNA, 356 bp, Artificial
  Mutation in BnaA.FAD2.a introduced by TALE nuclease pair BnFAD2_T02
cctctcctccctcaccctctcccttacctcgcctgtcccctctactgggcctgccaaggctgcgtcctaacgggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgttggaacgcaccgtgatgttaacggttcagttcactctcggctggcctttgtacttag

SEQ ID NO: 17303 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17304 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcgggcctttgtacttag

SEQ ID NO: 17305 - DNA, 291 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccattccaacactggctccctcgagagagacgaagtgtttgtccccaagaagaaatccgacatcaagtggtacggcaagtacctcaacaaccctttgggacgcaccgtgatgttaacggttcagttcactctcggctggcctttgtacttag

SEQ ID NO: 17306 - DNA, 341 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtcggcctcatcttccactccttcctcctcgtccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17307 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17308 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 17309 - DNA, 387 bp, Artificial
  Mutation in BnaA.FAD2.a introduced by TALE nuclease pair BnFAD2_T02
cctctcctccctcaccctctcccttacctcgcctggctcctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctccaagccccccagcaggtggtggccatcgccagcaatagtcatcgacgccaccattccaacactgtctccctcgagagagacgaagtgtttgtccccaatatgaagtcagacatcaagtggtacggcaagtacctcaacaaccctgtgggacgcgccgtgatgttatcggttcagttcactctcggctggcctttgtccttag

SEQ ID NO: 17310 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctgcacgaccccgtgggcctcgtcttccactccttcctcctcgtcccttacttctcctggatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17311 - DNA, 385 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcaagccgtgggcctggcacagcaccggcaacagccgctggaccgtctccagctgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 17312 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttcccctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17313 - DNA, 315 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccaatggcggtggcaagcaggcgctggagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17314 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 17315 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactatcggctggcctttgtacttag

SEQ ID NO: 17316 - DNA, 356 bp, Artificial
  Mutation in BnaA.FAD2.a introduced by TALE nuclease pair BnFAD2_T02
cctctccttcctcaccctctcccttacctcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17317 - DNA, 356 bp, Artificial
  Mutation in BnaA.FAD2.a introduced by TALE nuclease pair BnFAD2_T02
cctctcctccctcaccctctatcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagtcatcgacgccaccattccaacactgtctccctcgagagagacgaagtgtttgtccccaagaagaagtcagacatcaagtggtacggcaagtacctcaacaaccctttgggacgcaccgtgatgttaacggttcaggtcactcgcgggtggcatttatacttag

SEQ ID NO: 17318 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaacatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactcgcggctggcctttgtacttag

SEQ ID NO: 17319 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagggatgaagtgttcgtccccaagaagaaatccgacatcaagtggtacggaaagtacctcaacaacccgctaggacgcacggggatgctaaccgtccagttcacgctcggctggcctttgtacttag

SEQ ID NO: 17320 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggatgcgtcctaaccggcgtctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaaatccgacatcaagtggtacggaaagtacctcaacaacccgctaggacgcacggggattctaaccgtgcagttcacgctcggctggcctttgtacttag

SEQ ID NO: 17321 - DNA, 356 bp, Artificial
  Mutation in BnaA.FAD2.a introduced by TALE nuclease pair BnFAD2_T02
cctctcctccctcaccctctctcctacttcgccttgcctctctactgggcctgtcaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcaaacatcgagtggtacggcaagtacctcaacaacccgttgggacgcaccgtaatgttaccggttcagttcactctcggctggcctttgtacttag

SEQ ID NO: 17322 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttactactcctggaagcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17323 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgttcgtccccaagaagaagtcagacatcaagtggtacggcaagtacctcaacaacccgttgggacgcaccgtgatgttaacggttcagttcactctcggctggcctttgtacttag

SEQ ID NO: 17324 - DNA, 358 bp, Artificial
  Mutation in BnaA.FAD2.a introduced by TALE nuclease pair BnFAD2_T02
cctctcctccctccccctctctcctccttcgcctggcctctctactgggcctgcccgggctgcgtcctaaccggcgtctgggtcatagcccccgcgtgcggccaccacgccttcagccactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcgccgtgaggttaacggttcagttcactctcggctggccgttgtacttag

SEQ ID NO: 17325 - DNA, 406 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtactccagcgcctgcttgccaccattattgctggcgatggccaccacctgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17326 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacgaccctgtgggacgcaccgtgaggttaacggttccgttcactctcggctggcctttgtacttag

SEQ ID NO: 17327 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggctcagttcactctcggctggcctttgtacttag

SEQ ID NO: 17328 - DNA, 356 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggcttgacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17329 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggcttcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 17330 - DNA, 353 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcctctgggtcatcgcccacgaatgcggccaccacgccttcagcgactaccagtggctggacgacaccgtcggcctcatcttccactccttcctcctcgtcccttacttctcctagtcatcgacgccaccattccaacactggctccctcgagagagacgaagtgtttgtccccaagaagaagtcagacatcaagtggtacggcaagtacctcaacaaccctttgggacgcaccgtgagtttaacggttcagttcactctcggctggcctttgtacttag

SEQ ID NO: 17331 - DNA, 415 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaaaaacaaagttaaacattatgagggaagcggtgatcgccgaagtatcgactcaactatcagaggcgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17332 - DNA, 367 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtacacacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17333 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctagtcatcgacgccaccattccaacactggctccctcgagagagacgaagtgtttgtccccaagaagaagtcacacatcaagtggtacggcaagtacctcaacatccctttgggacgcaccgtgatgttaacggttcagttcactctcggctggcctttgtacttag

SEQ ID NO: 17334 - DNA, 326 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 17335 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacatcgacgccaccattccaacactggctccctcgagagagacgaagtgtttgtccccaagaagaagtcagacatcaagtgatacggcaagtacctcaacaaccctttgggacgcgccgtgatgttaacggttcagttcactctcggctggcctttgtacttag

SEQ ID NO: 17336 - DNA, 399 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcacttacttctcctggaagtagccgaagtttccaaaaggtcgttgatcaaagctcgccgcgttcatcgacgccaccattccaacactggttccctcgagagagacgaagtgtttgtccccaagaagaagtcagacatcaagtggtacggcaagtacctcaacaaccctgtgggacgcgccgggaggttaacggtgcagttcactctcggctggcctttgtacttag

SEQ ID NO: 17337 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 17338 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggattcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 17339 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 17340 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgagtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17341 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacgccgtgggcctcgtcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 17342 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaatcatcgacgccaccattccaacactggctccctcgagagagactaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17343 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggctggacgacaccgtcggcctcatcttccactccttcctcctcgtcccttacttctcctggaatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17344 - DNA, 357 bp, Artificial
  Mutation in BnaA.FAD2.a introduced by TALE nuclease pair BnFAD2_T02
cctctcctccctcaccctctctcctacttcgcctggactctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcatttcactctcggctggcctttgtacttag

SEQ ID NO: 17345 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 17346 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggaaagtacctcaacaacccgctaggacgcacggtgaggctaaccgtccagttcacgctcggctggcctttgtacttag

SEQ ID NO: 17347 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctgtgtacttag

SEQ ID NO: 17348 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagggatgaagtgttcgtccccaagaagaaatccgacatcaagtggtacggaaagtacctcaacaacccgctaggacgcacggtgaggctaaccgtacagttcacgctcggctggcctttgtacttag

SEQ ID NO: 17349 - DNA, 352 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17350 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccataaaacaaagttaaacattgggcttcctggagccgcccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17351 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactcag

SEQ ID NO: 17352 - DNA, 356 bp, Artificial
  Mutation in BnaA.FAD2.a introduced by TALE nuclease pair BnFAD2_T02
cctctcctccctcaccctctctcctacttcgcctgccctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17353 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtctcttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17354 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaggccatcgacgccaccattccaacaccggatccctcgagagggatgaagtgtttgtccccaagaagaagtcagacatcaagcggtacggcaagtacctcaacaaccctttgggacgcaccgtgatgttaacggttcagttcactctcggctggcctttgtacttag

SEQ ID NO: 17355 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctccagtcatcgacgccaccgttccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 17356 - DNA, 354 bp, Artificial
  Mutation in BnaA.FAD2.a introduced by TALE nuclease pair BnFAD2_T02
cctctcctccctcacactctctcctacttcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17357 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactcattcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17358 - DNA, 409 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttgcttctcctggagcaacagccgctggaccgtctccagcgcctgcttgccgccatcgtggctggcgagtcatcgacgccaccattccatcactggctccctcgagagagacgaagtgtatgtccccaagaagaaatcagacatcaagtggtacggcaagtacctcaacaaccctttgggacgcaccgtgatgttaacggttcagttgactctcggctggcctttgtacttag

SEQ ID NO: 17359 - DNA, 358 bp, Artificial
  Mutation in BnaA.FAD2.a introduced by TALE nuclease pair BnFAD2_T02
cctctcctccctcaccctctctcctacctcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 17360 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacgccaagtacctcgacacccctttgggacacaccgtgatgtcaacggttcagttccctctcggctggcctttgtacttag

SEQ ID NO: 17361 - DNA, 356 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaacatcgacgccaccattccaacactggctccctcgagagagacgaagtgtttgtccccaagaagaagtcagacatcaagtggtacggcaagtacctcaacaaccctttgggacgcaccgtgatggtaacggttcagttcactctcggctggcctttgtacttag

SEQ ID NO: 17362 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaactcatcgacgccaccattccaacactggctccctcgagagagacgaagtgtttgtccccaagaagaagtcagacatcaagtggtacggcaagtacctcaacatccctttgggacgcaccgtgatgttaacggttcagttcactctcggctggcctttgtacttag

SEQ ID NO: 17363 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactgccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17364 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcataaccggcgtctgggtcatagcccacgagtgcggccaccacgccttcagcgactaccagtggcttgacgacaccgtcggtctcctcttccactgcttcctcctcgtcccttacttctcctggcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 17365 - DNA, 347 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttatccatgacgccaccattccaacaccggatccctcgatagggacgaagtgttcgtccccaagaagaaatccgacatcaagtggtacggcaagtacctcaacaacccgctaggacgcacggtgatgctaaccgtccagttcaagctcggctggcctttgtacttag

SEQ ID NO: 17366 - DNA, 356 bp, Artificial
  Mutation in BnaA.FAD2.a introduced by TALE nuclease pair BnFAD2_T02
cctctcctccctcaccctctcacttacctcgcctggcccctctactgggcccgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaattcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17367 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 17368 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaaatccgacatcaagtggtacggaaagtacctcaacaacccgctaggacgcacggtgatgctatccgtccagttcacgctcggctggcctttgtacttag

SEQ ID NO: 17369 - DNA, 356 bp, Artificial
  Mutation in BnaA.FAD2.a introduced by TALE nuclease pair BnFAD2_T02
cctctcctccctcaccctctcccttacctcgcctgtcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacacccctgtgggccgcaccgtgagtttaacggatcaattcactctcggttgccctttgtacttag

SEQ ID NO: 17370 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaattcatcgacgccaccattccaacactggctccctcgagagagacgaagtgtttgtccccgagaagaagtcagacatcaagtggtacggcaagtacctcaacaaccctttgggacgcaccgtgatgttaacggttcagttcactctcggctggcctttgtacttag

SEQ ID NO: 17371 - DNA, 291 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggaagactggctccctcgagagagacgaactgtttgtccccaagaagaaatccgacatcaagtggtacggaaagtacctcaacaacccgctaggacgcacggtgatgctaaccgtccagttcacgctcggctggcctttgtacttag

SEQ ID NO: 17372 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctgcacgacaccgtcggcctcatcttccactccttcctcctcgtcccttacttctcctggaatatcatcgacgccaccattccaacactggctccctcgagagagacgaagtgtttgttcccaagaagaagtcagacatcgagtggcaaggcaagtacctcaacaagcgtttgggacggaccgtgatgtttacggctcaggtcactcccgcccgcccttagcgcttag

SEQ ID NO: 17373 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcataggccacgagtgcggccaccacgccttcagcgactaccagtggctggacgacaccgtcggcctcatcttccactccttcctcctcgtcccttacttctcctggaaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17374 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcggcctttgtacttag

SEQ ID NO: 17375 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccatggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17376 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctggtcatcgcccacgaatgcggccaccacgccttcagcgaccaccagtggctggacgacgccgtgggcctcgtcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17377 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtcttggtcatagcccacgagtgcggccaccacgccttcagcgactaccagtggctggacgacaccgtcggcctcatcttccactccttcctcctcgtcccttacttctcctggagtacagtcatcgacgccaccattccaacactggctccctcgagagagacgaagtgtttgtccccaagaagaagtcagacatcaagtggtaccgcaagtacctcaacaaccctttgggacgcaccgtgatgttaacggttcagttcactctcggctggcctttgtacttag

SEQ ID NO: 17378 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcatcgacgccaccattccaacactggctccctcgagagagacgaagtgtttgtccccacgaacaagccacacatcacctggttacgcaggtacctaagcatgcctccgagacgccccgtggtgtaaacggctcagttcaggctaggctggcctttgtaactag

SEQ ID NO: 17379 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctatgggacgcaccgtgatgttaacggttcagttcactctcggctggcctttgtacttag

SEQ ID NO: 17380 - DNA, 350 bp, Artificial
  Mutation in BnaA.FAD2.a introduced by TALE nuclease pair BnFAD2_T02
cctctcctccctcaccctctctcctacttcgcctggcctctctactgtgcctgccagggctgcgtcctaacgggcgtctgggtcatcgcccacgaatgcggccaccacgccttcagcgaccaccagtggctggacgacgccgtgggcctcgtcttccactccttcctcctcgtcccttacttctcctcatcgacgccaccattccaacaccggatccctcgagagagacgaagtgtttgtccccaagaagaagtcagacatcaagtggcacggcaagtacctgaacacccctgtgggacacaaggtgctgccacccgtcccgttcacgctcggctggcctttgtacttag

SEQ ID NO: 17381 - DNA, 312 bp, Artificial
  Mutation in BnaA.FAD2.a introduced by TALE nuclease pair BnFAD2_T02
cctctcctccctcaccctctctcctacttcgcctggcctctctactgggcctgtcagggctgcgtcctaaccggcgtctgggtcatagcccacgagtgcggccaccacgccttcagcgactaccagtggctggacgacaccgtcggcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17382 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgaccaccagtggctggacgacaccgtcggcctcatcttccactccttcctcctcgtcccttacttctcctggaagtcatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 17383 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttacagtcatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 17384 - DNA, 305 bp, Artificial
  Mutation in BnaA.FAD2.a introduced by TALE nuclease pair BnFAD2_T02
cctctcctccctcaccctctctcctacttcgcctggcctctccactgggcctgccagggctgcgccctaaccggcgtctgggtcatagcccacgagtgcggccaccacgccttcagcgactaccagtggctggacgacaccgtcatcgacgccaccattccaacactggctccctcgagagagacgaagtgtttgtccccaagaagaagtcagacatcaagtggtacggcaagtacctcaacaaccctttgggaggcaccgggatgttaacggttcagttcactctcggctggcctttgtactta

SEQ ID NO: 17385 - DNA, 324 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgactaccagtggctggacgacaccgtcggcctcatcttccactccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17386 - DNA, 452 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacggccaccacctgctccggggtcaagccgtgggcctggcacagttggaaacttcggcttcccctggagagagcgagattctccgcgctgtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17387 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgaatgcggccaccacgccttcagcgactaccagtggctggacgacaccgtcggcctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17388 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcctcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaacccttggggacgcgcggtgatgttagcggttcagtttactctcggctggcctttgtacttag

SEQ ID NO: 17389 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacgggtcagttcactctcggctggcctttgtacttag

SEQ ID NO: 17390 - DNA, 345 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 17391 - DNA, 354 bp, Artificial
  Mutation in BnaA.FAD2.a introduced by TALE nuclease pair BnFAD2_T02
cctctcctccctcaccctctcccttacctcgcctggcccctctactggacctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctgtgggacgcaccgggatgttaacggttcagttcactctcggctggcctttgtacttag

SEQ ID NO: 17392 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacgacaagtacctcaacaaccctttgggacgcaccgtgatgttaacggttcagttcactctcggctggcctttgtacttag

SEQ ID NO: 17393 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagtgctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17394 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacagtcatcgacgccaccattccaacactggctccctcgagagagacgaagtgtttgtccccaagaagaagtcagacatcaagtggtacggcaagtacctcaacaaccctctgggacgcaccgtgatgttaacggttcagttcacgctcggctggcctttgtacttag

SEQ ID NO: 17395 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcccatcgatgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17396 - DNA, 354 bp, Artificial
  Mutation in BnaA.FAD2.a introduced by TALE nuclease pair BnFAD2_T02
cctctcctccctcaccctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaaatccgacatcaagtggtacggcaagtacctcaacaaccctttgggacgcaccgtgatgttaacggttcagttcactctcggctggcctttgtacttag

SEQ ID NO: 17397 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17398 - DNA, 360 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17399 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcgacgccaccattccaacaccggatccctcgagagagacgaagtgtttgtccccaagaagaagtcagacatcaagtggtacggcaagtacctcaacaacccgctaggacgcacggtgatgctaaccgtccagttcactctcggctggcctttgtacttag

SEQ ID NO: 17400 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgtgcctctgggtcatcgcccacgaatgcggccaccacgccttcagcgaccaccagtggctggaccacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17401 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttcttctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17402 - DNA, 433 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccgtctttgaacgttgtgatggccaccaatggcggcggctgttgccggtgctgtgccaggcccacggcttgacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcccggctggcctttgtgcttag

SEQ ID NO: 17403 - DNA, 439 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcctcttccactccttcctcctcgtcccttacttctcctggaagtgccggtgctgtgccaggcccacggcttgaccccggagcaggtggtggccatcgccagccacgatggcggcaagcaggcgcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17404 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctgtgggacgcaccgtgagtttaacggttcagttcactctcggctggcctttgtacttag

SEQ ID NO: 17405 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggcctcatcttccactccttcctcctcgtcccttacttctccttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17406 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctagagagagacgaagtgtttgtccccaagaagaagtcagacatcaagtggtacggcaagtacctcaacaaccctttgggacgcaccgtgatgttaacggttcagttcactctcgtctggcctttgtacttag

SEQ ID NO: 17407 - DNA, 401 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggcgctggagacggtccagcggctgttgccggtgctgtgccaatagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 17408 - DNA, 360 bp, Artificial
  Mutation in BnaA.FAD2.a introduced by TALE nuclease pair BnFAD2_T02
cctctcctccctcaccctctcccctacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17409 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17410 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgactgggtcatagcccacgagtgcggccaccacgccttcagcgactaccagtggcttgacgacaccgtcggtctcatcttccactccttcctcctcgtcccttacttctcctggaagttacagtcatcgacgccaccattccaacactggctccctcgagagagacgaagtgtttgtccccaagaagaagtcagacatcaagtggtacggaaagtacctcaacaacccgctaggacgcgcggtgatgctaaccgtccagttcacgctcggctggcctgtgtacttag

SEQ ID NO: 17411 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctgtgggacgcaccgggatgttaacggttcagttcactctcggctggcctttgtacttag

SEQ ID NO: 17412 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17413 - DNA, 351 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggctggacgacaccgtcggcctcatcttccactccttcctcctcgtcccttacttctcctgcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcgggtggcctttgtacttag

SEQ ID NO: 17414 - DNA, 395 bp, Artificial
  Mutation in BnaA.FAD2.a introduced by TALE nuclease pair BnFAD2_T02
cctctcctccctcaccctctcccttacctcgcctggcccctctaatgggcctgccaaggctgcgtcctaacgggcctctgggtcatcgcccacgaatgcggccaccacgccttcagcgactaccagtggctggacgacgccgtgggcatcgtcttccactccttcctcctcgtcccttacttctcctggaagttgaccccccagcaggtgctggccatcgccagccaacagtcatcgacgccaccattccaacactggctccctcgagagagacgaagtgtttgtccccaagaagaagtcagacatcaagtggtacggcaagtacctcaacaaccctttggaacgcaccgtgatgttatcggttcatttgactcgtgggtggcctttgtacttag

SEQ ID NO: 17415 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtatcatcgacgccaccattccaacactggctccctcgagagagacgaagtgtttgtccccaagaagaagtcagacatcaagtggtacggcaagtacctcaacaacccgctaggacgcacggtgaggctaaccgtccagttcacgctcggctggcctttgtacttag

SEQ ID NO: 17416 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaagtctgcgtcctaacgggcctctgggtcatagcccacgagtgcggccaccacgccttcagcgactaccagtggctggacgacaccgtcggcctcatcttccactccttcctcctcgtcccttacttctcctggacatcgacgccaccattccaacactggctccctcgagagagacgaagtgtttgtccccaagaagaagtcagacatcaagtggtacggcaagtacctcaacaagcctttgggacgcaccgtgatgttaacggttcagttcactctcggctggcctttgtacttag

SEQ ID NO: 17417 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactcctttctcctcgtcccttactcctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17418 - DNA, 331 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctccatcgacgccaccattccaacactggctccctcgagagagacgaagtgtttgtccccaagaagaagtcagacatcaagtggtacggcaagtacctcaacaaccctgtgggacgcaccgtgagtttaacggttcggttgactctaggctggcctttgtacttag

SEQ ID NO: 17419 - DNA, 416 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggacacaggccaacttctcaagattgcaaaacgtggcggcgtgaccgcagtggaggtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17420 - DNA, 437 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtaccgtctccagcgcctgttgccggtgctgtgccaggcccacggcttgaccccggagcaggtggtggccatcgccatacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 17421 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctaatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 17422 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactcctccctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17423 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctgaattacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17424 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtctgccactccttcctcctcgtcccttacttctcctggatcaacgacgccaccattccaacactggctccctcgagagagacgaagtgtttgtccccaagaagaagtcagacatcaagtggtacggcaagtacctcaacaaccctttgggacgcaccgtgatgttaacggttcagttcactcggggctggcctttgtacgtag

SEQ ID NO: 17425 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgggagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17426 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccatcggcctcatcttccactccttcctcctcgtcccttacttctcctggaagtcatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 17427 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtccctcacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17428 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgttgggacgcaccgggatgttaacggttcagttcactctcggctggcctttgtacttag

SEQ ID NO: 17429 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccctcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17430 - DNA, 355 bp, Artificial
  Mutation in BnaA.FAD2.a introduced by TALE nuclease pair BnFAD2_T02
cctctcctccctcaccctctctcctacttcgcctggactctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaacatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggctggcctttgtacttag

SEQ ID NO: 17431 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaacaaatcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 17432 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 17433 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaaatccgacatcaagtggtacggaaagtacctcaacaacccgctaggacgcacggtgaggctaaccgtccagttcacgctcggctggcctttgtacttag

SEQ ID NO: 17434 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgcgcggctggcctttgtacttag

SEQ ID NO: 17435 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 17436 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactag

SEQ ID NO: 17437 - DNA, 315 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17438 - DNA, 357 bp, Artificial
  Mutation in BnaA.FAD2.a introduced by TALE nuclease pair BnFAD2_T02
cctctcctccctcaccctctctcctacttcgcctggcctctctaatgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgttatgttaacggttcagttcactctcggctggcctttgtacttag

SEQ ID NO: 17439 - DNA, 355 bp, Artificial
  Mutation in BnaA.FAD2.a introduced by TALE nuclease pair BnFAD2_T02
cctctcctccctcaccctctaccttacctcgcctggcctctctactgggcctgccaaggctgcgtcctaacgggcgtctgggtcatagcccacgagtgcggccaccacgccttcagcgactaccagtggcttgacgacaccgtcggcctcatcttccactccttcctcctcgtcccttacttctcctggaatcatcgacgccaccattccaacactggctccctcgagagagacgaagtgtttgtccccaagaagaaggcagacatcaagtggtacggcaagtacctcaacaacccttagggacgcaccgtgatgttatcgggtcagttcgctcttggctggccttgatgcttag

SEQ ID NO: 17440 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17441 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 17442 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactcgcggctggcctttgtacttag

SEQ ID NO: 17443 - DNA, 365 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtacaaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17444 - DNA, 356 bp, Artificial
  Mutation in BnaA.FAD2.a introduced by TALE nuclease pair BnFAD2_T02
cctctcctccctcaccctctctcctacttcgcctgccctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17445 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacgcccctgtgggacgcgccgtattggtagcggtgcaggtcactctcggcgggcctttgtacttag

SEQ ID NO: 17446 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17447 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaacgggcctctgggtcatcgcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17448 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggactacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17449 - DNA, 294 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctccttgtcaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17450 - DNA, 354 bp, Artificial
  Mutation in BnaA.FAD2.a introduced by TALE nuclease pair BnFAD2_T02
cctctcctccctcaccctctctcctacttcgcctggcacctctactgggcctgccaaggctgcgtcctaacgggcctctgggtaatcgcccacgaatgcggccaccacgccttcagcgaccaccagtggctggacgacgccgtgggcctcgtcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctctgggacgcaccgtgattttatcggttcagttcactctcggcgggcctttgtacttag

SEQ ID NO: 17451 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccgggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17452 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaataagaagtcagacatcaagtggtacggcaagtacctcaacaaccctgtgggacgcaccgtgatgttaacggttcagttcactctcggctggcctttgtacttag

SEQ ID NO: 17453 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccttgaatcgacgccaccattccaacactggctccctcgagagagacgaagtgtttgtccccaagaagaagtcagacatcaagtggtacggcaagtaccccaacacccctttgggacgcaccgtgatgttaacggttcagttcactctcggctggcctttgtacttag

SEQ ID NO: 17454 - DNA, 291 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcggcgactaccagtggcttgacgacaccgtcggaagactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17455 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgtgacgcaccgtgatgttaacggttcagttcactctcggctggcctttgtacttag

SEQ ID NO: 17456 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 17457 - DNA, 335 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtgggcctcgtcttccactccttcctcctcgtcccttactcaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17458 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 17459 - DNA, 417 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcaacttgaccccggagcaggtggtggcccacggcttgaccccccagcaggtggtggcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccctttgtacttag

SEQ ID NO: 17460 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttaatcgtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17461 - DNA, 349 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctatcgacgccaccattccaacactggctccctcgagagagacgaagtgtttgtccccaagaagaagtcaaacatcaagtggtacggcaagtacctcaacaaccctttgggacgcaccgtgatgttaacggttcagttcactctcggctggcctgagtacttag

SEQ ID NO: 17462 - DNA, 466 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcctcttccactccttcctcctcgtcccttacttctcctggaattgcccagttatctcgccctgatccggcgttggccgcgttgatttgtacggctccgcagtggatggcggcctgcctcaactcggatttcttctcctccagctcggacttagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttctcgctcggctggcctttgtacttag

SEQ ID NO: 17463 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaaagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggccttagtacttag

SEQ ID NO: 17464 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaatcatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17465 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggatggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcagtcgcggctggcatttgtacttag

SEQ ID NO: 17466 - DNA, 346 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggagccaccattccaacactggctccctcgagagagacgaagtgtttgtccccaagaagaagtcagacatcaagtggtacggcaagtacctcaacaaccctctgggacgcaccgtgatgttaacggttcagttcactctcggctggccttagtacttag

SEQ ID NO: 17467 - DNA, 453 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagcgcaacggctgttgccggtgctgtgccaggcccacggcttgaccccccagcaggtggtggccaccgccagcaatggcggtggcaagcaggcgctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17468 - DNA, 349 bp, Artificial
  Mutation in BnaA.FAD2.a introduced by TALE nuclease pair BnFAD2_T02
cctctcctccctcaccctctctcctacttcgcctggcctccctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcccatcgacgccaccattccaacactggctccctcgagagagacgaagtgtttgtccccaagaagaagtcagacatcaagtggttcggcaagtacctcaacagccgtgtgggacgcacagtgatgttaacggttcagttcactctcggctggcctttgtacttag

SEQ ID NO: 17469 - DNA, 416 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtcggcctcatcttccactccttcctcctcgtcccttacttctcctggaaggacacaggccaacttctcaagattgcaaaacgtggcggcgtgaccgcagtggaggtacagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 17470 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttatcggttcagttcactcgcggctggcctttgtacttag

SEQ ID NO: 17471 - DNA, 353 bp, Artificial
  Mutation in BnaA.FAD2.a introduced by TALE nuclease pair BnFAD2_T02
cctctcctccctcaccctctatcctacttcgcctggcctctctactgggcctgccaaggatgcgtcctaaccggcgtctgggtcatagcccacgagtgcggccaccacgccttcagcgactaccagtggctggacgacaccgtcggcctcctcttccactccttcctcctcgtcccttacttctcctgatcatcgacgccaccattccaacactggctccctcgagagagactaagtgtttgtccccaagaagaagtcacacatcaagtggtacggcaagtacctcaacaaccctttgggacgcttcgggatgttaacggttcaggtcactctcggcgggcctttttgcttag

SEQ ID NO: 17472 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgacttcagtgactaccagtggctggacgacaccgtcggcctcatcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaacccgctaggacgcacggggatgctaaccgtccaggtcacgctcggctggcctttgtacttag

SEQ ID NO: 17473 - DNA, 388 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagccttctgcttagtttgatgcctggcagtacagtcatcgacgccaccattccaacactggctccctcgagagagacgaagtgtttgtccccaagaagaagtcagacatcaagtggtacggcaagtacctcaacaaccctttgggacgcaccgtgacgttaacggttcagttcactctcggccggcctttgtacttag

SEQ ID NO: 17474 - DNA, 356 bp, Artificial
  Mutation in BnaA.FAD2.a introduced by TALE nuclease pair BnFAD2_T02
cctctcctccctcaccctctctcctacttcgcctggcctctctactgggcctgtcagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17475 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccaccccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17476 - DNA, 329 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactaccagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 17477 - DNA, 356 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacatcgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 17478 - DNA, 357 bp, Artificial
  Mutation in BnaA.FAD2.a introduced by TALE nuclease pair BnFAD2_T02
cctctcctccctcaccctctctcctacttcgcctggcctctctactgggcctgacagggctgcgccctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatctagtgatccggcaagtaccccaacacgcctgagggacgcaagataatgttaacggttccgttccctctcggctggcctttgtacttag

SEQ ID NO: 17479 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttggaacgcaccgtgatgttaacggttcatttcactcgcggctggcctttgtacttag

SEQ ID NO: 17480 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggcctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 17481 - DNA, 357 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacagtcatcgacgccaccattccaacactggctccctcgagagagacgaagtgtttgtccccaagaagaagtcagacatcaagtggtacggcaagtacctcaacaaccctttgggactcaccgtgatgttaacgggtcatttcactctcggctggcctttgtacttag

SEQ ID NO: 17482 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccaggggctggacgacaccgtcggcctcatcttccactccttcctcctcgtcccttacttctcctggaaagtcatcgacgccaccattccaacactggctccctcgagagagccgaagtgtttgtccccaagaagaagtcagacatccagtggtccggcaagcccctcaacaaccctttgggacgcaccgtgatgttaaaggttcagttcactctcggctagcattagtactcag

SEQ ID NO: 17483 - DNA, 354 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggcttgacgacaccgtgggcctcgtcttccactccttcctcctcgtcccttacttctcctggaacatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 17484 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggaaagtacctcaacaacccgctaggacgcacggtgatgctagccgtccagttcacgctcggctggcctttgtacttag

SEQ ID NO: 17485 - DNA, 448 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtactccagcgcctgcttgccgccatcgtggctggcgatggccaccacctgctccggggtcaagccgtgggcctggcacagcaccggcaacagtcatcgacgccaccattccaacactggctccctcgagagagacgaagtgtttgtccccaagaagaagtcagacatcaagtggtacggcaagtacctcaacaaccctttgggacgcaccgtgatgttagcggttcagttcactctcggctggccttggtacttag

SEQ ID NO: 17486 - DNA, 354 bp, Artificial
  Mutation in BnaA.FAD2.a introduced by TALE nuclease pair BnFAD2_T02
ccctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 17487 - DNA, 346 bp, Artificial
  Mutation in BnaA.FAD2.a introduced by TALE nuclease pair BnFAD2_T02
cctctcctccctcaccctctaccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17488 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctccttgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17489 - DNA, 356 bp, Artificial
  Mutation in BnaA.FAD2.a introduced by TALE nuclease pair BnFAD2_T02
cctctcctccctcaccctctctcctacttcgcctggtctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccagtccaacactggctccctcgagagagacgaagtgtttgtccccaagaagaagtcagacatcaagtggtacggcaagtacctcaacaaccctttggaacgctccctgatattaacggttcagttcactctggtgtggcctttgtgcttag

SEQ ID NO: 17490 - DNA, 345 bp, Artificial
  Mutation in BnaA.FAD2.a introduced by TALE nuclease pair BnFAD2_T02
cctctcctccctcaccctctctcctacttcgcatggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17491 - DNA, 365 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcacacgaatgcggccaccacgccttcagcgaccaccagtggctggacgacgccgtgggcctcgtcttccactccttcctcctcgtcccttacttcctcctcgtcccttacttctcatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17492 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtatacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 17493 - DNA, 358 bp, Artificial
  Mutation in BnaA.FAD2.a introduced by TALE nuclease pair BnFAD2_T02
cctctcctccctcaccctctcacctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 17494 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgaccaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17495 - DNA, 335 bp, Artificial
  Mutation in BnaA.FAD2.a introduced by TALE nuclease pair BnFAD2_T02
cctctcctccctcaccctctaccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttactcaccattccaacactggctccctcgagagagacgaagtgtttgtccccaagaagaagtcagacatcaagtggtacggcaagcacctcaacaaccctttgggacgcaccgtgatgttaacggttcagttcactctcggctggcctttgtacttag

SEQ ID NO: 17496 - DNA, 348 bp, Artificial
  Mutation in BnaA.FAD2.a introduced by TALE nuclease pair BnFAD2_T02
cctctcctccctcaccctctatcctacttcgcctggaccatctactgggcctgccagggctgcgtcctaaccggcgtctgggtcatagcccacgagtgcggccaccacgccttcagcgactaccagtggcttgacgacaccgtcggtcccctcttccactccttcctcctcgtcccttacttctccatcgacgccaccattccaacactggctccctcgagagagacgaagtttttgtccccaagaagaaggctatcatcaactggtacggcgagtacctcaacagcctatagggactcggcggtatggtaggtgttcagttccgtcgcggctggcctgtgtacctag

SEQ ID NO: 17497 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctgggcgacaccgtcggcctcatcttccactccttcctcctcgtcccttacttctcctggaagttcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 17498 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17499 - DNA, 443 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctgcgatggccaccacctgctggggggtcaagccgtgggcctggcacagcaccggcaacagccgctggaccgtctccagcgcctgcttgtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 17500 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagggatgaagtgttcgtccccaagaagaaatccgacatcaagtggtacggaaagtacctcaacaacccgcgaggacgcacggtgatgctatccgtccagttcacgctcggcgggccttggtacctag

SEQ ID NO: 17501 - DNA, 352 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctgacgggcctctgggtcatcgcccacgaatgcggccaccacgccttcagcgaccaccagtggctggacgacgccgtgggcctcgtcttccactccttcctcctcgtcccttacttctcctggcatcgacgccaccattccaacactggctccctcgagagagacgaagtgtttgtccccaagaagaagtcagacatcaagtggtacggcaagtacctcaacaacccgttgggacgcaccgggatgttaacggttcagttcactctcggctggcctttgtacttag

SEQ ID NO: 17502 - DNA, 358 bp, Artificial
  Mutation in BnaA.FAD2.a introduced by TALE nuclease pair BnFAD2_T02
cctctcctccctcaccctctcccttacctcgcctggccactctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccttgtggacgcaccgtgatgttaacggttcagtgcactctcggctggccctttgtacttag

SEQ ID NO: 17503 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 17504 - DNA, 356 bp, Artificial
  Mutation in BnaA.FAD2.a introduced by TALE nuclease pair BnFAD2_T02
cctctccgccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaactcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgcgcggctggcctttgtacttag

SEQ ID NO: 17505 - DNA, 402 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggactgccgctgccaagttcgagagacagcacatggacagcatcgatacagtcatcgacgccaccattccaaaactggctccctcgagagagacgaagtgtttgtccccaagaagaagtcagacatcaagtggtacggcaagtacctcaaccaccttttgggacgcgccgtgatgttaacggttcagttcactctcggctggcctttgtacttag

SEQ ID NO: 17506 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttgtcatcgacgccaccattccaacaccggatccctcgagagagacgaagtgtttgtccccaagaagaagtcagacatcaagtggtacggcaagtacctcaacaaccatttgggacgcaccgtgatgttaacggttcagttcactctcggctggcctttgtacttag

SEQ ID NO: 17507 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 17508 - DNA, 356 bp, Artificial
  Mutation in BnaA.FAD2.a introduced by TALE nuclease pair BnFAD2_T02
cctctcctccctcaccctctaccctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtgcttag

SEQ ID NO: 17509 - DNA, 323 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccgctcgccgcagccgaacgaccgagaagaagtcagacatcaagtggtacggcaagtacctcaacaaccctttgggacgcaccgtgatgttaacggttcagttcactcgcggctggcctttgtacttag

SEQ ID NO: 17510 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattctaacactggctccctcgcgagagacgaagtgtttgtccccacgaagaagtcagacaacaagtggcacggcaagtccctccacaccccgctggatcgccccgtgccgttaccgtttcagttcactctcggctggcatgaatacttag

SEQ ID NO: 17511 - DNA, 458 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagcggtccagcggctgttgccaccatcattgctggcgatggccaccacctgctggggggtcaagccgtgggcctggcacagcaccggcaacagccgctggagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17512 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 17513 - DNA, 358 bp, Artificial
  Mutation in BnaA.FAD2.a introduced by TALE nuclease pair BnFAD2_T02
cctctcctccctcaccctctcccttaactcgcctggacccactactgggcccgccaaggccgcgtccaaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgttcccaagaagaagtcagacatcaagtggtacggcaagtacctcaacaacccgctaggacgcgcggggagtctatccgtccaggtcacgttcggctggcctttttacttag

SEQ ID NO: 17514 - DNA, 358 bp, Artificial
  Mutation in BnaA.FAD2.a introduced by TALE nuclease pair BnFAD2_T02
cctctcctccctcaccctctctcctacttcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17515 - DNA, 355 bp, Artificial
  Mutation in BnaA.FAD2.a introduced by TALE nuclease pair BnFAD2_T02
cctctcctccctcaccctctcccttacctcgcctggtcactctactgggcttgcaaaggccgcgccctaaagggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtaccccaacacccctttgggacgcaacgggatgttaacggttcagttcactctcggctggcctttgtacttag

SEQ ID NO: 17516 - DNA, 353 bp, Artificial
  Mutation in BnaA.FAD2.a introduced by TALE nuclease pair BnFAD2_T02
cctctcctccctcaccctctctcctacttctccttgcctctctactgggcctgcccgggctgcgtcctaacctgcgtctgggtcatagcccacgagtgcggccaccacgccttcagcgactaccagtggcttgacgacaccgtcggtctcatcttccactccttcctcctcgtcccttacttctcctggtcatcgacgccaccattccaacactggctccctcgagagggatgaagtgttcgtccccaagaagaaatccgacatcaagtggtccggaaagtacctcaacacccctgtgggacgcaccgtgatgttaacggctcagttcacgctcggctggcctttgtccttag

SEQ ID NO: 17517 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 17518 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctgttggacgcaccgtgatgttaacggttcagttcactctcggctggcctttgtacttag

SEQ ID NO: 17519 - DNA, 469 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtgcgccgttaccaccgctgcgttcggtcaaggttctggaccagttgcgtgagcgcatacgctacttgcatacttgacagcgacggtccctaacgctgccgggtgttggcttagtcatcgacgccaccattccaacactggctccctcgagagagacgaagtgtttgtccccaagaagaagtcagacatcaagtggtacggcaagtacctcaacaacccttcgggacgcaccgtgatgttaacggttcagttcacgctcggctggcctttgtacttag

SEQ ID NO: 17520 - DNA, 363 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactacttcctcctcgtcccttacttctcctggaagtatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17521 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggccccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 17522 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgagtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17523 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggcagcgtcctaacgggcctctgggtcatcgcccacgaatgcggccaccacgccttcagcgaccaccagtggctggacgacaccgtcggtctcatcttccactccttcctcctcgtcccttacttctcctggtcatcgacgccaccattccaacactggctccctcgagagagacgaagtgtttgtccccaagaagaagtcagacatcaagtggtacggcaagtacatcaacaaccctttgggacgcaccgtgatgttaacggttcagttcactctcggctggcctttgtacttag

SEQ ID NO: 17524 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaaacagccatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgcgcggctggccttagtacttag

SEQ ID NO: 17525 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgccccgtgatgttaacggttcagttcacgctcggctggcctttgtacttag

SEQ ID NO: 17526 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgattttaacggttcagttcactctcggctggcctttgtacttag

SEQ ID NO: 17527 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttaatcgtgtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 17528 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 17529 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17530 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17531 - DNA, 383 bp, Artificial
  Mutation in BnaA.FAD2.a introduced by TALE nuclease pair BnFAD2_T02
cctctcctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctccaagccccccagcaggtggtggccatcgccagcaatagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17532 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcgggcctttgtacttag

SEQ ID NO: 17533 - DNA, 324 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17534 - DNA, 394 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacgccattgctggcgatggccaccacctgctggggggtcagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 17535 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaacccttggggacgcaccgtgatggtaacggttcaggtcacgctcggctggcctttgtactgag

SEQ ID NO: 17536 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacataaagtggtacggcaagtacctcaacaaccctttgggacgcaccgtgatgttaacggttcagttcactctcggctggcctttgtacttag

SEQ ID NO: 17537 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggctggacgacaccgtcggcctcatcttccactccttcctcctcgtcccttacttctcctgtaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17538 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttaggacgcaccgtgatgttaacggttcagttcactctcggctggcctttgtacttag

SEQ ID NO: 17539 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 17540 - DNA, 460 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagcgatggccaccacctgctggggggtcaagccgtgggcctggcacagcaccggcaacagccgcgggaccgtccccagcgcctgctggcaaccgccattgctggcgatggtcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17541 - DNA, 312 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17542 - DNA, 408 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagtaccggtgctgtgccaggcccacggcttgaccccccagcaggtggtggccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17543 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtgcttag

SEQ ID NO: 17544 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattcaaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17545 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggaagtatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17546 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgatagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 17547 - DNA, 329 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactaccagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 17548 - DNA, 353 bp, Artificial
  Mutation in BnaA.FAD2.a introduced by TALE nuclease pair BnFAD2_T02
catctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17549 - DNA, 336 bp, Artificial
  Mutation in BnaA.FAD2.a introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactcgcggctggcctgtgtacttag

SEQ ID NO: 17550 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagtgcacgctcggctggcctttgtacttag

SEQ ID NO: 17551 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttttacttag

SEQ ID NO: 17552 - DNA, 384 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctgggcgctcggtcgttcggctgcggcgagcggagtcatcgacgccaccattccaacactggctccctcgagagagacgaagtttttgtccccaagaagaagtcagacatcaagtggtacggcaagtacctcaacaaccctttgggacgcaccgtgatgttaacggttcagttcactctcggctggcctttgtacttag

SEQ ID NO: 17553 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctcatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17554 - DNA, 396 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcaatttgttgcaacgaacaggtcactatcagtcaaaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17555 - DNA, 348 bp, Artificial
  Mutation in BnaA.FAD2.a introduced by TALE nuclease pair BnFAD2_T02
ctctcatccctcaccctctctcctacttcgcctggcctctctactgggcctgccaagggtgcgtcctaaccggcgtctgggtcatagccacgagtgcggccaccacgccttcagcgactaccagtggctggacgacaccgtcggcctcatcttccactccttcctcctcgtcccttacttctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17556 - DNA, 358 bp, Artificial
  Mutation in BnaA.FAD2.a introduced by TALE nuclease pair BnFAD2_T02
cctctcctccctcaccctctctcctacttcgcctggcctctttactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccaggaagtaccatcgacgccaccattccaacactggctccctcgagagagacgaagtgtttgtccccaagaagaagtcagacatcaagtggtacggcaagtacctcaacaaccctttgggacgcaccgtgatgttaacggttcagttcgctctcggctggcctttgtacttag

SEQ ID NO: 17557 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 17558 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggactctgggtcatcgcccacgaatgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17559 - DNA, 356 bp, Artificial
  Mutation in BnaA.FAD2.a introduced by TALE nuclease pair BnFAD2_T02
cctctcctccctcaccctctgtcctacttcgcctggcctctctactgggcctgccaagggtgcgtcctaaccggcgtctgggtcatagcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggcctttgtacttag

SEQ ID NO: 17560 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 17561 - DNA, 357 bp, Artificial
  Mutation in BnaA.FAD2.a introduced by TALE nuclease pair BnFAD2_T02
cctctcctccctcaccctctctcctacttcgcgtgccctctcgactgtgcctgccaggtctgagtcctaaccggcgtctgggtcatagcacacgagtgcgtccaccacgccttcagcgactacaagtggcttgacgacaacgtcggtctcatcttccactccttcctcctcgtcccttacttctcctggaaagtcatcgacgccaccattccaacactggctccctcgagagagacgaagtgtttgtccccaagaagaagtcagacatcacgtggttcgcctcgtcctccacaacgccattgggatgcaccatgctgctaccggttcctttccctctcggctggcctttgtacttag

SEQ ID NO: 17562 - DNA, 408 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagttgctggacgacaccgtcggcctcatcttccactccttcctcctcgtcccttacttctcctggaaccgtcgctgtcaagtatcaggacatgatcgcagcgttgccagaggcgacacagtcatcgacgccaccagtccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17563 - DNA, 471 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggccatagcccacgagtgcggccaccacgccttcagcgactaccagtggcttgacgacaccgtcggtctcatcttccactccttcctcctcgtcccttacttctcctggaatactaataaaacgaaaggcccagtcttgctggcgatggcaagcaggcgctggagacgctggagagcattgctgcccagttatctcgccctgatccggcgttggccgcggtgaccagtcatcgacgccaccattccaacactggctccctcgagagagacgaagtgtttgtccccaagaagaaagccgacatcaagtggtacggaaagtacctcaacaacccgctaggacgcacggtgatgctaaccgtccaggtcacgctcggctggcctttgtacttag

SEQ ID NO: 17564 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 17565 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 17566 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 17567 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17568 - DNA, 356 bp, Artificial
  Mutation in BnaA.FAD2.a introduced by TALE nuclease pair BnFAD2_T02
cctatcctccctcaccctctctcctacttcgcctggcctctctactgggcctgccaagggtgcgtcctaaccggcgtctgggtcatagcacacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 17569 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 17570 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttccgtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 17571 - DNA, 310 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggtctcatcttccaccattccaacactggcttcctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 17572 - DNA, 408 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtcttggtcatagcccacgagtgcggccaccacgccttcagcgactaccagtggcttgacgacaccgtcggtctcatcttccactccttcctcctcgtcccttacttctcctggaagttgagcggggcacccgtcagtgcattgcgccatgcatgcactgcctccaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17573 - DNA, 387 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctgggcctggcacagcaccggcaacagccgctggacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17574 - DNA, 359 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcttggctggcctttgtacttag

SEQ ID NO: 17575 - DNA, 359 bp, Artificial
  Mutation in BnaA.FAD2.a introduced by TALE nuclease pair BnFAD2_T02
cctctcctccctcaccctctcccttacctcggctggcccctctactgggcctgccaaggctgcgtcctaacgggcctctgggtcatcgcccacgaatgcggtcaccacgccttcagcgaccaccagtggctggacgacgccgtgggcctcgtcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17576 - DNA, 417 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaaggatttgtcctaatcaggagagcgttcaccgacaaacaacagataaaacgaaaggccgtcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17577 - DNA, 360 bp, Artificial
  Mutation in BnaA.FAD2.a introduced by TALE nuclease pair BnFAD2_T02
cctctcctccctcaccctctatcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagaaagtcatcgacgccaccattccaacactggctccctcgagagagacgaagtgtttgtccccaagaagaagtcagacatcaagtggtacggcaagtacctcaacaaccctttgggactcaccgtgatgttaacggttcagttcactctcggctggcctttgtacttag

SEQ ID NO: 17578 - DNA, 353 bp, Artificial
  Mutation in BnaA.FAD2.a introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggctggacgacgccgtgggcatcgtcttccactccttcctcctcgtcccttacttctcctggtcatcgacgccaccattccaacactggctccctcgagagagacgaagtgtttgtccccaagaagaggtcagacatcaagtggtacgacaagtacctcaacaaccctttgggacgccccggaatattatcggttcagttcactttcggctggcctttgtacttag

SEQ ID NO: 17579 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggccttagtacttag

SEQ ID NO: 17580 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtaccccaacaaccctgtgggacgcaccgtgatgttaacggttcagttccctctcggctggcctttgtacttag

SEQ ID NO: 17581 - DNA, 413 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtggccatcgccagccactgactcgctgcgctcggtcgttcggctgcggcgagcggtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 17582 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctccatcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 17583 - DNA, 341 bp, Artificial
  Mutation in BnaA.FAD2.a introduced by TALE nuclease pair BnFAD2_T02
cctctcctccctcaccctctcccttacctcgcctggcccctctcctgggcatgccaaggctgcgtcctaacgggcctctgggtcatcgcccacgaatgcggccaccacgccttcagcgaccaccagtggctggacgacaccgtcggcctcatcttccactccttcctcctcgtccagtcatcgacgccaccattccaacactggctccctcgagagagacgaagtgtttgtccccaagaagaagtcagacatcaagtggtacggcaagtacctcaacaaccctttgggacgcaccgtggtgttaacggttcaggtcacgctcggctggcctttgtacttag

SEQ ID NO: 17584 - DNA, 363 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17585 - DNA, 346 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggagccaccattccaacactggctccctcgagagagacgaagtgtttgtccccaagaagaagtcagacatcaagtggtacggcaagtaccccaacgagcctgagggacgcaacgggatgttaacggtccagttcactctcggctggcctttgtacttag

SEQ ID NO: 17586 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 17587 - DNA, 340 bp, Artificial
  Mutation in BnaA.FAD2.a introduced by TALE nuclease pair BnFAD2_T02
cctctcctccctcaccctttcccttacctcgcctggccactctaatgggcctgccaaggctgcgtcctaacgcgcctctgggtcatcgcccacgaatgcggccaccacgccttcagcgaccaccagtggctggacgacgccgtgggcctcgtcttccactccttcctcctcgtccctcatcgacgccaccattccaacactggctccctcgagagagacgaagtgtttgtccccaagaagaagtcagacatcaagtggtacggcaaggaccgcaacaaccctttgggacgcaccgtgatgttaacggttgatttcactctcgggtggcctttagactgag

SEQ ID NO: 17588 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17589 - DNA, 427 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctccagcgcctgcttgccaccattattgctggcgatggccaccacctgctggggggtcaagccgtgggcctggcacagcaccggacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17590 - DNA, 277 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacctgagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 17591 - DNA, 315 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 17592 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaaagtcatcgacgccaccattccaacactggctccctcgagagagacgaagtgtttgtccccaagaagaagtcagacatcaagtggtacggcaagtacctcaacaaccctttgggacgcaccgggatgttaacggtgcagttcactctcggctggcctttgtacttag

SEQ ID NO: 17593 - DNA, 359 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaacagtcatcgacgccaccattccaacactggctccctcgagagagacgaagtgtttgtccccaagaagaagtcagacatcaagtggtacggcaagtacctcaacaaccttttgggacgcaccgtgatgttaacggttcagttcactctcggctggcctttgtacttag

SEQ ID NO: 17594 - DNA, 359 bp, Artificial
  Mutation in BnaA.FAD2.a introduced by TALE nuclease pair BnFAD2_T02
cctctcctccctcaccctctcccttacctcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17595 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgccccgtgatgttaacggttcagttcactcgcggcgggcctttgtacttag

SEQ ID NO: 17596 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatctgccactccttcctcctcgtcccttacttctccagtcatcgacgccaccattccaacactggctccctcgagagagacgaagtgtttgtccccaagaagaagtcagacatcaagtggtacggcaagtacctcaacaaccctttgggacgcaccgtaatgttaacggttcagttcactctcggctggcctttgtacttag

SEQ ID NO: 17597 - DNA, 358 bp, Artificial
  Mutation in BnaA.FAD2.a introduced by TALE nuclease pair BnFAD2_T02
cctctcctccctcaccctctctcctacttcgcctggactctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 17598 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17599 - DNA, 405 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatgacggatggccttctgcttagtttgatgcctggcagtttatggcgggcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17600 - DNA, 354 bp, Artificial
  Mutation in BnaA.FAD2.a introduced by TALE nuclease pair BnFAD2_T02
cctctcctccctcaccctatcccttacctcgcctgccccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcatcgacgccaccattccaacactggctccctcgagagagacgaagtgtttgtccacaagaagaagtcagacatcaagtggtacggcaagtacctcaacaaccctttgggacgcaccgtggtgttaacggttcagttcactctcggcgggcctttgtacttag

SEQ ID NO: 17601 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggcctttgtacttag

SEQ ID NO: 17602 - DNA, 356 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggaagtcatcgatgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17603 - DNA, 360 bp, Artificial
  Mutation in BnaA.FAD2.a introduced by TALE nuclease pair BnFAD2_T02
cctctcctccctcaccctctctcctactgcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtaagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17604 - DNA, 354 bp, Artificial
  Mutation in BnaA.FAD2.a introduced by TALE nuclease pair BnFAD2_T02
cctctcctccctcaccctctctcctacttcgcctggcctctctactgggcctaccagggctgcgtcctaaccggcgtctgggtcatagcccacgagtgctgccaccacgccttcagcgactaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccatttgggtagcaccgtgaggttaacggttcagttcactctcggctggcctttgtacttag

SEQ ID NO: 17605 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 17606 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtgactggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17607 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgtgaacggttcagttcactctcggctggcctttgtacttag

SEQ ID NO: 17608 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctcctcgagagagacgaagtgtttgtccccaagaagaagtcagacatcaagtggtacggcaagtacctcaacaacccgctaggacgcacggtgatgctaaccgtccagttcacgctcggctggcctttgtactag

SEQ ID NO: 17609 - DNA, 393 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacaacactggctccctcgagagagacgaagtgtttgtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 17610 - DNA, 352 bp, Artificial
  Mutation in BnaA.FAD2.a introduced by TALE nuclease pair BnFAD2_T02
cctctcctccctcaccctctctcctacttcgcctggcctctctactaggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 17611 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaacagtcatcgacgccaccattccaacactggctccctcgagagagacgaagtgtttgtccccaagaagaagtcagacgtcaagtggtacggcaagtacctcaacaaccctttgggacgcaccgtgatgttaacggttcagttcactctcggctggcctttgtacttag

SEQ ID NO: 17612 - DNA, 387 bp, Artificial
  Mutation in BnaA.FAD2.a introduced by TALE nuclease pair BnFAD2_T02
cctctcctccctcaccctctgtcctacttcgcctggcctctctcctcggcctgccagggctgcgtcctaaccggcgtctgggtcatagcccaccagtgcggccaccacgccttcagcgactaccagtggctggacgacaccgtcggcctcctcttccactccttcctcctcgtcccttacttctcctggaaggcgatggccaccacccgctccggggtcacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgccgctggcctttgcacttag

SEQ ID NO: 17613 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaacccttttggacgcaccgtgatgttaacggttcagttcactctcggctggcctttgtacttag

SEQ ID NO: 17614 - DNA, 294 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctccttgtcaagtgtttgtccccaagaagaagtcagacatcaagtggtacggcaagtacctcaacaaccctttgggacgcaccgtgatgttaacggttcagttcactctcggttggcctttgtacttag

SEQ ID NO: 17615 - DNA, 401 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggcgctggagacggtccagcggctgttgccggtgctgtgccaatagtcatcgacgccaccattccaacactggctccctcgagagagacgaagtgtttgtccccaagaagaagtcagacatcaagtggtccggcaagtacctcaacaaccctttgggtcgcaccgtgatgttaacggttcagttcactctcggctggcctttgtacttag

SEQ ID NO: 17616 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcttggctggccgttgtacttag

SEQ ID NO: 17617 - DNA, 343 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttgccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 17618 - DNA, 372 bp, Artificial
  Mutation in BnaA.FAD2.a introduced by TALE nuclease pair BnFAD2_T02
cctctcctccctcaccctctctcctacttcgcctggcctctctactgggcctgccaggactgcgtcctaaccggcgtcttggtcatagcccacgagtgcggccaccacgccttcagcgactaccagtggcttgacgacaccgtcggtctcatcttccactccttcctcctcgtcccttactcaagtcagaggtggcgaaacccgacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17619 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgttcgtccccaagaagaaatccgacatcaagtggtacggaaagtacctcaacaacccgctaggacgcacggtgatgctaaccgttcagttcacgctcggctggcctttgtacttag

SEQ ID NO: 17620 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 17621 - DNA, 355 bp, Artificial
  Mutation in BnaA.FAD2.a introduced by TALE nuclease pair BnFAD2_T02
cctctcctccctcaccctctgtcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaaacatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactcgcggctggcctttgtacttag

SEQ ID NO: 17622 - DNA, 329 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactaccagtcatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17623 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagctactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggaaagtcccccaccaccccgctaggacgcacggtgctgctaaccgtccagttcccgctcggctggcctttgtacttag

SEQ ID NO: 17624 - DNA, 454 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctgacggtccagcggctgttgccggtgctgtgccaggcccacggcttgaccccccagcaggtggtggccatcgccagcaatggcggtggcaagcaggcgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17625 - DNA, 393 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacaacactggctccctcgagagagacgaagtgtttgtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 17626 - DNA, 356 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaaatccgacatcaagtggtccgtcaagtcccccaccgccccgcaagtacgcaaggtgctgctaaccgtcccgttcccgctcggctggcctttgtacttag

SEQ ID NO: 17627 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 17628 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagggattaagtgttcgtccccaagaagaaatccgacatcaagtggtacggaaagtacctcaacaacccgctaggacgcacggtgatgctaaccgtccagtacacgctcggctggcctttgtacttag

SEQ ID NO: 17629 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagcagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 17630 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgttcgtccccaagaagaagtcagacatcaagtggtacggaaagtacctcaacaacccgctaggacgcacggtgatgctaaccgttcagttcacgctcggctggcctttgtacttag

SEQ ID NO: 17631 - DNA, 358 bp, Artificial
  Mutation in BnaA.FAD2.a introduced by TALE nuclease pair BnFAD2_T02
cctctcctccctcaccctctctcctacttcgcctggactctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacagcaagtggtacggcaagtacctcaacaacccgtggggaggcaccgtgatgttaaccgtccagttcacgctggggtggcctttttactta

SEQ ID NO: 17632 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcatctgggtcatagcccacgagtgcggccaccacgccttcagcgactaccagtggctggacgacaccgtcggcctcatcttccactccttcctcctcgtcccttacttctcctggaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17633 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 17634 - DNA, 355 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 17635 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccattccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17636 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaccatgacgccaccattccaacaccggatccctcgatagggacgaagtgttcgtccccaagaagaaatccgacatcaagtggtacggcaagtacctcaacaacccgctaggacgcacggtgatgctaaccgtccagttcacgctcggctggcctttgtacttag

SEQ ID NO: 17637 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagtacacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17638 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcagcaacccgctaggacgcaccgtgatgttaacggttcagttcacgctcggctggcctttgtacttag

SEQ ID NO: 17639 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17640 - DNA, 379 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtacggccaccacgccttcagcgactaccagtggctggacgacaccgtcggcctcatcttccactccttccactccttacttactcgtcccctacaacctgcccatcggccaggccgacgccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17641 - DNA, 394 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtgagtcacgttatgacccccgccgatgacgcgggacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17642 - DNA, 415 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcctcttccactccttcctcctcgtcccttacttctcctggaagtccgcctttgagtgagctgataccgctcgccgcagccgaacgaccgagcgcagcgagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17643 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaaagccatcgacgccaccattccaacactggctccctcgagagagacgaagtgtttgtccccaagaagaagtcagacatcaagtggtacggcaagtacctcaacaaccctttgggacgcaccgggatgttaacggttcagttcacgctcggctggcctttgtacttag

SEQ ID NO: 17644 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacatcgacgccaccattccaacactggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 17645 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 17646 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttccccctcgcccctaacttctcctggaagcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 17647 - DNA, 312 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcgacgccaccattccaacactggctccctcgagagagacgaagtgtttgtccccaagaagaagtcagacatcaagtggtacggcaggtacctcaacaaccctttgggacgcaccgtgatgttaacggttcagttcactcgcggctggcctttgtacttag

SEQ ID NO: 17648 - DNA, 348 bp, Artificial
  Mutation in BnaA.FAD2.a introduced by TALE nuclease pair BnFAD2_T02
cctctcctccctcaccctctcccttacctcgcctggaccctctactgggcctgccaaggctgcgtcctaacgggcgtctgggtcatagcccacgagtgcggccaccacgccttcagcgactaccagtggcttgacgacgccgtgggcctcgtcttccactccttcctcctcgtcccttacttagtcatcgacgccaccattccaacactggctccctcgagagagacgaagtgtttgtccccaagaagaagtcagacatcaagtggtacggcaagtaccgcaacaaccgttagggacgcaccggggtgtgaacggttcagttcactctcggctggcctttgtacttag

SEQ ID NO: 17649 - DNA, 384 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagcaaatatttcttgtcaaaaatgctccaccatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 17650 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccatcggcctcatcttccactccttcctcctcgtcccttacttctcctggaagtcatcgacgccaccattccaacactggctccctcgagagagacgaagtgtttgtccccaagaagaagtcagacatcaagtggtacggcaagcacctcaacagccctttgggacgcaccgtgatgttaacggttcagttcactctcggctggcctttgtacttag

SEQ ID NO: 17651 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggagccatcgacgccaccattccaacactggctccctcgagagagacgaagtgtttgtcgccaagaagaagtcagacatcaagtggtacggcaagtacctcaacaaccctttgggacgcaccgtgatgttaacggttcagttcactcgcggctggcctttgtacttag

SEQ ID NO: 17652 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtctgcctcatcttccactccttcctcctcgtcccttacttctcctggaagtacacagtcatcgacgccaccattccaacactggctccctcgagagagacgaagtgtttgtccccaagaagaagtcagacatcaagtggtatggcaagtacctcaacaaccctttgggacgcaccgtgatgttaacggttcagttcactctcggctggcctttgtacttag

SEQ ID NO: 17653 - DNA, 336 bp, Artificial
  Mutation in BnaA.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17654 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactta

SEQ ID NO: 17655 - DNA, 357 bp, Artificial
  Mutation in BnaA.FAD2.a introduced by TALE nuclease pair BnFAD2_T02
cctctcctccctcaccctctctcctacttcgcctggcctctctcctgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttcatcgacgccaccattccaacactggctccctcgagagagacgaagtgtttgtccccaagaagaagtcagacatcaagtggtacggcaagtccttcaacacccctgtgggacgcaccgtgctgtcaacggttcagttcactctcggctggcctttgtacttag

SEQ ID NO: 17656 - DNA, 291 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 17657 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17658 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17659 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 17660 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 17661 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgctaggacgcacggtgatgctaaccttccagttcacgctcggctggcctttgtacttag

SEQ ID NO: 17662 - DNA, 340 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtccctcatcgacgccaccattccaacactggctccctcgagagagacgaagtgtttgtccccaagaagaagtcagacatcaagtggtacagaaagtacctcaacaacccgctaggacgcacggtgatgctaaccgtccagtgcacgctcggctggcctttgtacttag

SEQ ID NO: 17663 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggaaagtacctcaacatcccgctaggacgcacggtgatgctaagcgtccagttcacgctcggctggcctttgtacttag

SEQ ID NO: 17664 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagatagacgaagtgtttgtccccaagaagaagtcagacatcaagtggtactgcaagtacctcaacaaccctttgggacgcaccgtgatgttaacggttcagttcactctcggctggcctttgtacttag

SEQ ID NO: 17665 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcttggctggcctttgtaattag

SEQ ID NO: 17666 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagtgagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17667 - DNA, 359 bp, Artificial
  Mutation in BnaA.FAD2.a introduced by TALE nuclease pair BnFAD2_T02
cctctcctccctcaccctctgtcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagggatgaagtgttcgtccccaagaagaaagccgacatcaagtggtacggaaggtacctcaacatccctctaggacgcgcgggggggcgaaccgtccagttcacgctcggctggcctttgtacttag

SEQ ID NO: 17668 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17669 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggagtcatcgacgccaccattccaacactggctccctcgagagagacgaagtgtttgtccccaagaagaagtcagacatcaagtggtacggcaagtacctcaacacccctgagggacgcaccgtgatgttaacggttcagctcactctcggctggcctttgtacttag

SEQ ID NO: 17670 - DNA, 324 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17671 - DNA, 354 bp, Artificial
  Mutation in BnaA.FAD2.a introduced by TALE nuclease pair BnFAD2_T02
cctctcctccctcaccctatctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcgccgtgatgttaacggtgcatttcactcgcggctggcctttgtacttag

SEQ ID NO: 17672 - DNA, 347 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcatcgacgccaccattccaacactggctccctcgagagagacgaagtgtttgtccccaagaagaagtcagacatcaagtggtacggcaagtacctcaacaacccttggggacgcgccgtgatgttaacggttcagttcactctcggctggcctttgtacttag

SEQ ID NO: 17673 - DNA, 329 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactaccagtcatcgacgccaccattccaacactggctccctcgagagagacgaagtgtttgtccccaagaagaaatccgacatcaagtggtacggaaaggaccgcaacaacccgctaggacgcacggtgatgctaaccggcgagttcacgctcggctggccgttgtacttag

SEQ ID NO: 17674 - DNA, 355 bp, Artificial
  Mutation in BnaA.FAD2.a introduced by TALE nuclease pair BnFAD2_T02
cctctcctccctcaccctatctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17675 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccttgatgttaacggttcagttcactctcggctggcctttgtacttag

SEQ ID NO: 17676 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaagtaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactta

SEQ ID NO: 17677 - DNA, 372 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttactcaagtcagaggtggcgaaacccgacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 17678 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggaaagtcatcgacgctaccattccaacactggctccctcgagagagacgaagtgtttgtccccaagaagaagtcagacatcaagtggtacggcaagtacctcaacaacccgttgggacgcaccgtgatgttaacggttcagttcactcgcggctggcctttgtacttag

SEQ ID NO: 17679 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtaacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 17680 - DNA, 387 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggcgatggccaccacctgctccggggtcacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 17681 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctcaccggcgtctgggtcatagcccacgagtgcggccaccacgccttcagcgaccaccagtggctggactacgccgtgggcctcgtcttccactccttcctcctcgtcccttacttctcctggagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 17682 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactgactccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17683 - DNA, 406 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtctcatattcactctcaatccaaataatctgcaccggatctcgcccatagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcccggctggcctttgtacttag

SEQ ID NO: 17684 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaaggcagacatcaagtggtccggcaagtacctcaacaacccgttgggacgcaccgggatgttaacggttcagttcactcgcggctggcctttgtacttag

SEQ ID NO: 17685 - DNA, 474 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgattaccagtggctggacgacaccgtcggcctcatcttccactccttcctcctcgtcccttacttctcctggaagtacagccgctggacacgtctccagcgcctgcttgccgccatcgtggctggcgatggccaccccctgctccggggtcaagccgtgggcctggcacagcaccggcaacagccgctggaccgtctcgacgccaccattccaacactggctccctcgagagagacgaagtgtttgtccccaagaagaagtcagacatcaagtggtacggcaagtaccacaacaacccttggggacgcaccgtgatgttaacggttcagttcactctcggctggcctttgtacttag

SEQ ID NO: 17686 - DNA, 358 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttggacttag

SEQ ID NO: 17687 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttttcctggaagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 17688 - DNA, 356 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgtggccaccacgccttcagcgaccaccagtggctggacgacgccgtgggcctcgtcttccactccttcctcctcgtcccttacttctcctggaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttctctctcggctggcctttgtacttag

SEQ ID NO: 17689 - DNA, 356 bp, Artificial
  Mutation in BnaA.FAD2.a introduced by TALE nuclease pair BnFAD2_T02
cctctcctccctcaccctctctcctacttcgcctggcctctctacttggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaaatccgacatcaagtggtacggaaagtacctcaacaacccgctaggacgcacggggatgctaaccgtccagttcacgcgcggctggcctttgtacttag

SEQ ID NO: 17690 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttctctctcggctggcctttgtacttag

SEQ ID NO: 17691 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgtgaacggttcagttcactctcggctggcctttgtacttag

SEQ ID NO: 17692 - DNA, 332 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17693 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacatcgacgccaccattccaacactggctccctcgagagagacgaagtgtttgtccccaagaagaagtcagacatcaagtggtacggcaagtacctcaacatccctttgggacgcaccgtgatgttaacggttcagttcactctcggctggcctttgtacttag

SEQ ID NO: 17694 - DNA, 363 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacatcccttttggacgcaccgtgatgttaacggttcagttcactctcggcgggcctttgtacttag

SEQ ID NO: 17695 - DNA, 355 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17696 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtaccgcaacaaccctttgggacgcaccgtgatgttaacggttgagttcactctcggctggcatttatacttag

SEQ ID NO: 17697 - DNA, 389 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaagtctggcgccgtcgggcttcctggagccgcccagcaatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 17698 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggtgcaggtcactctcggccggcctttgtacttag

SEQ ID NO: 17699 - DNA, 346 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggatgacaccgtcggcctcatcttccactccttcctcctcgtcccttacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 17700 - DNA, 356 bp, Artificial
  Mutation in BnaA.FAD2.a introduced by TALE nuclease pair BnFAD2_T02
cctctcctccctcaccctctcccttacctcgcctggcccctctactgagcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtgcggcaagtacctcaacaaccctttgggacgcaccgtgatgttaacggttcagttcactctcggctggcctttgtacttag

SEQ ID NO: 17701 - DNA, 323 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggcctcatcttccactccttcctcctcgtcccttacttctcctggaagtaccgctcgccgcagccgaacgaccgagaagaagtcagacatcaagtggtacggcaagtacctcaacaaccctttgggacgcaccgtgatgttaacggttcagttcactctcggctggcctttgtacttag

SEQ ID NO: 17702 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtccggcaagtagccgaacgagcctgagggacgcacggtgatgttaacggttcagttcactctcggctggcctttgtacttag

SEQ ID NO: 17703 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcctcgcccacgaatgcggccaccacgccttcagcgactaccagtggctggacgacaccgtcggactcatcttccactccttcctcctcgtcccttacttctcctggaaagtcatcgacgccaccattccaacactggctccctcgagagagacgaagtgtttgtccccaataagaagtcagacatcaagtggtacggcaagtaccgcaacaaccggttggggcgcaccgtgatggtaacggttcagttcactctcggctggccgttgtacttag

SEQ ID NO: 17704 - DNA, 389 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgcgggcctcgtcttccactccttcctcctcgtcccttacttctcctggaagtacagcaacgtcggttcgagatggcgctcgaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17705 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgactaccagtggctggacgacaccgtcggcctcatcttccactccttcctcctcgtcccttacttctcctggaacgacgccaccattccaacactgactccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17706 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctactggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17707 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 17708 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctcaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctgtgggacgcaccggaatgttaacggttcagttcactctcggctggcctttgtacttag

SEQ ID NO: 17709 - DNA, 273 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacaaatgcggccaccacgccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17710 - DNA, 454 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacgatgttccagattacgctatcgatatcgccgatctacgcacgctcggctacagccagcagcaacaggagaagatcaaaccgaaggtgcgttcgagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17711 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaagccgacatcaagtggtacggcaagtacctcaacaaccctttgggacgcaccgtgatgttatcggtgcagttcactcgcggctggcctttgtacttag

SEQ ID NO: 17712 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaaatccgacatcaagtggtacggcaagtacctcaacaaccctttgggacgcaccgtgatgttaacggttcagttcactctcggctggcctttgtacttag

SEQ ID NO: 17713 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 17714 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaacagtcatcgacgccaccattccaacactggctccctcgagagagacgaagtgtttgtcccaaagaagaagtcagacatcaagtggtacggcaagtacctcaacaaccctttgggacgcaccgtgatgttaacggttcagttcactctcggctggcctttgtacttag

SEQ ID NO: 17715 - DNA, 442 bp, Artificial
  Mutation in BnaA.FAD2.a introduced by TALE nuclease pair BnFAD2_T02
cctctcctccctcaccctctaccttacctcgcctggcctctctactgggcctgccagggctgcgtcctaaccggcgtctgggtcatagcccacgaatgcggccaccacgccttcagtgaccaccagtggctggacgacgccgtgggcctcgtcttccactccttcctcctcgtcccttacttctcctggaagtaggcgatggccaccacctgctccggggtcaagccgtgggcctggcacagcaccggcaacagcgcctgcaccgtctccagcgcctagtcatcgtcgccaccattccaacactggctccctcgagagagacgaagtgtttgtccccaagaagaagtcagacatcaagtggtacggcaagtacctcaacaaccctttgggacgctccgttatgttaacggttcagttcactctcggctggcctttgtactag

SEQ ID NO: 17716 - DNA, 391 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgtaggtcgttcgctccaagctgggctgtgtgcacgaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17717 - DNA, 356 bp, Artificial
  Mutation in BnaA.FAD2.a introduced by TALE nuclease pair BnFAD2_T02
cctctcctccctcaccctctatcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttcgcctggaagccatcgacgccaccattccaacaccggatccctcgagagagacgaagtgtttgtccccaagaagaagtcagacatcaagtggttcggaaagtacctcaacaacccgctaggaagcgcggtgatgctatccgtccaggtctctcactggtcgccattatacttag

SEQ ID NO: 17718 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctttgggacgcaccgtgattttaacggttcagttcactctcggctggcctttgtacttag

SEQ ID NO: 17719 - DNA, 352 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctgtcatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17720 - DNA, 353 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17721 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtcttggtcatagcccacgagtgcggccaccacgccttcagcgactaccagtggctggatgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17722 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17723 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacaacggcgagctttgatcaacgaccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 17724 - DNA, 354 bp, Artificial
  Mutation in BnaA.FAD2.a introduced by TALE nuclease pair BnFAD2_T02
cctctcctccctcaccctatcccttacctcgcctcccccctctactgggcctcccaaggctgcttcctaccgggcctctggttcatcgcccacgaatgcggccaccaccccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggatgcaccgtgatgttaacggttcagttctctctcggctggcctttgtacttag

SEQ ID NO: 17725 - DNA, 336 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 17726 - DNA, 363 bp, Artificial
  Mutation in BnaA.FAD2.a introduced by TALE nuclease pair BnFAD2_T02
cctctcctccctcaccctctctcctacttcgcctgccctctccactgggcctgccaaggctgcgtcctaacgggcctctgggtcatcgcccccgaatgcggccaccacgccttcagcgaccaccagtggctggacgacgccgtgggcctcgtcttccactccttcctcctcgtcccttacttctcctggaagtacacagtcatcgacgccaccatgccaacactggctccctcgagagagacgaagtgtttgtccccaagaagaagtcagacatcaagtggtacggcatgtacctcaacaaccctttgggacgcaccgtgatgttaacggttcagttcactctcggcaggccttagcacttag

SEQ ID NO: 17727 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17728 - DNA, 323 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccgctcgccgcagccgaacgaccgagaagaagtcagacatcaagtggtacggcaagtacctcaacaacccttttggacgcaccgtgatgttaacggttcagttcactctcggctggcctttgtacttag

SEQ ID NO: 17729 - DNA, 363 bp, Artificial
  Mutation in BnaA.FAD2.a introduced by TALE nuclease pair BnFAD2_T02
cctctcctccctcaccctctctcctacttcgcctgtcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtatacagtcatcgacgccaccattccaacactggctccctcgagagagacgaagtgtttgtccccaagaagaggtcagacatcaagtggtacggcaagtacctcaacaaccctttgggacgcaccgtgatgttaacggttcagttcactctcggctggcctttgtacttag

SEQ ID NO: 17730 - DNA, 383 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagactgagcctttcgttttatttgatgcgtcatcgacgccaccattccaacactggctccctcgagagagacgaagtggttgtccccaagaagaagtcagacatcaagtggtacggcaagtacctcaacacccctttgggacgcaccgtgatgttaacggttcagttcactctcggctggcctttgtacttag

SEQ ID NO: 17731 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcgtctggcctttgtacttag

SEQ ID NO: 17732 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgattttaacggttcagttccctctcggctggcctttgtacttag

SEQ ID NO: 17733 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggtcatcgacgccaccattccaacactggctccctcgagagagacgaagtgtttgtccccaagaagaaatccgacatcaagtggtacggaaagtacctcaacaacccgctaggacgcacggtgatgctatccggccatgtcactcctggctggcctttgtacttag

SEQ ID NO: 17734 - DNA, 358 bp, Artificial
  Mutation in BnaA.FAD2.a introduced by TALE nuclease pair BnFAD2_T02
cctctcctccctcaccctctctcctacttcgcatggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 17735 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacagcccgttgtgactcaccgtgatgttaacggttcattgctctctcggctggcctttgtacttag

SEQ ID NO: 17736 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggcgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggctggccttagtacttag

SEQ ID NO: 17737 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17738 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagaggcgaagtgtttgtccccaagaagaggtcagacatcaagtggtacgtcaggtacctcaacaacccgttgggacgcaccgtgatgttaacggttcagttcactctcggctggcctttgtacttag

SEQ ID NO: 17739 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttccgtcatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggctggcctttgtacttag

SEQ ID NO: 17740 - DNA, 354 bp, Artificial
  Mutation in BnaA.FAD2.a introduced by TALE nuclease pair BnFAD2_T02
cctctcctccctcaccctgtctcctacttcgcctgccctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 17741 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcgtcctcatcttccactccttcctcctcgtcccttacttctcctggaaggtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 17742 - DNA, 318 bp, Artificial
  Mutation in BnaA.FAD2.a introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17743 - DNA, 358 bp, Artificial
  Mutation in BnaA.FAD2.a introduced by TALE nuclease pair BnFAD2_T02
cctctcctccctcaacctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17744 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgtgagagacgaagtgtttgtccccaagaagaagtcagacatcaagtggtacggcaagtccctcaacacccctttgggacgcaccgtgatgttaacggttcagttcactctcggctggcctttgtgctttgc

SEQ ID NO: 17745 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaacccttagggacgcaccgtgaggttaacggttcaggtcactctcggctggcctttgtacttag

SEQ ID NO: 17746 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17747 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttttacttag

SEQ ID NO: 17748 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17749 - DNA, 357 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17750 - DNA, 358 bp, Artificial
  Mutation in BnaA.FAD2.a introduced by TALE nuclease pair BnFAD2_T02
cctctcctccctcaccctctctcctacttcgcctggtctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17751 - DNA, 353 bp, Artificial
  Mutation in BnaA.FAD2.a introduced by TALE nuclease pair BnFAD2_T02
cctctcctccctcaccctctctcctacttcgcctgacctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctccttgtcatcgacgccaccattccaacactggctccctcgagagagacgaagtgtttgtccccaagaagaagtcagacatcaagtggtacggcaagtacctcaacaacccttagggacgcaccgtgatgttaacggttcagttcactctcggctggcctttgtacttag

SEQ ID NO: 17752 - DNA, 357 bp, Artificial
  Mutation in BnaA.FAD2.a introduced by TALE nuclease pair BnFAD2_T02
cctctcctccctcaccctctgtcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17753 - DNA, 294 bp, Artificial
  Mutation in BnaA.FAD2.a introduced by TALE nuclease pair BnFAD2_T02
cctctcctccctcaccctcgctcctacttcgcctggcctctctcctgggcctgccagggctgcgtcctaaccggcgtctgggtcatagcccacgagtgcggccaccacgccttcagcgactaccagtggctggacgacaccgtcggcctcatcttccactccttcctccttgtcaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 17754 - DNA, 358 bp, Artificial
  Mutation in BnaA.FAD2.a introduced by TALE nuclease pair BnFAD2_T02
cctctcctccctcaccctctctcctacttcgtctggcctctctactgtgcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagggccatcgacgccaccattccaacactggctccctcgagagagacgaagtgtttgtccccaagaagaagtcagacatcaagtggtacggcaagtacctcaacaaccctttgggacgcaccatgctgtcacccgtccagttcacgctcggctggcctttgtacttag

SEQ ID NO: 17755 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaacccttatggacgcaccgtggtgttaacggttcaggtcactctcggctggcctttgtacttag

SEQ ID NO: 17756 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtccattacttctcctggaagtcatcgacgccaccattccaacactggctccctcgagagagacgaagtgtttgtccccaagaagaagtcagacatcaagtggtacggcaagtacctcaacaaccctttgggacgaaccgtgatgttaacggttcagttcactctcggctggcctttgtacttag

SEQ ID NO: 17757 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaaatccgacatcaagtggtacagaaagtacctcaacaacccgctaggacgcacggtgatgctaaccgtccagttcacgctcggctggcctttgtacttag

SEQ ID NO: 17758 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtctgtctcatcttccactccttcctcctcgtcccttacttctcctggcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17759 - DNA, 354 bp, Artificial
  Mutation in BnaA.FAD2.a introduced by TALE nuclease pair BnFAD2_T02
cctctcctccctcaccctctgccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcaaacatcgagtggtacggcaagtacctcaacaaccctttgggacgcaccgtgatgttaacggttcagttcacacgcggctggcctttgtacttag

SEQ ID NO: 17760 - DNA, 356 bp, Artificial
  Mutation in BnaA.FAD2.a introduced by TALE nuclease pair BnFAD2_T02
cctctcctccctcaccctctgtcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 17761 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgcgagagacgaagtgtttgtccccaagaagaaggcagacatcaagtggcacggcaagtgccttaacaacccgttgggacgcaccgggatgttatcggtgcatttcactcgcggctggcctttgtacttag

SEQ ID NO: 17762 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggaaagtacctcaacaaccggctaggacgcacggtgatgctaaccgtccagttcacgctcggctggcctttgtacttag

SEQ ID NO: 17763 - DNA, 356 bp, Artificial
  Mutation in BnaA.FAD2.a introduced by TALE nuclease pair BnFAD2_T02
cctctcctccctcaccctgtctcctacttcgcctggcttctctactgggcctgccagggctgcgccctaaccggcgtctgggtcatagcccacgagtgcggccaccacgccttcagcgactaccagtggctggacgacaccgtcggcctcatcttccactccttcctcctcgtcccttacttctcctggaagtcatagacgccaccattccaacactggctccctcgagagagacgaagtgtttgtccacaagaagaagtcagacatcaagtggtacggcaagtacctcaacaaccctgtgggacgcaccgtgaggttaacggttcagtccactctcggctggcctttgtacttag

SEQ ID NO: 17764 - DNA, 354 bp, Artificial
  Mutation in BnaA.FAD2.a introduced by TALE nuclease pair BnFAD2_T02
cctctcctccctcaccctctcccttacctcgcctggcccctctaatgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17765 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccgttgggacgcaccgggatgttaacggtgcagttcactctcggctggcctttgtacttag

SEQ ID NO: 17766 - DNA, 323 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccgctcgccgcagccgaacgaccgagaagaagtcagacatcaagtggtacggaaagtacctcaacaacccgctaggacgcacggtgatgctaaccgtccagttcacgctcggctggcctttgtacttag

SEQ ID NO: 17767 - DNA, 448 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtactccagcgcctacttgccgccatcgtggctggcgatggccaccacctgctccggggtcaagccgtgggcctgtctcagcaccggcaaaagtcatcgacgccaccattccaacactggctccctcgagagagacgaagtgtttgtccccaagaagaagtcggacatcaagtggtacggcaagtacctcaacaaccctttgggacgcaccgtgatgtaaacggtgcagttcactctcggctggcctgtgtacgtag

SEQ ID NO: 17768 - DNA, 356 bp, Artificial
  Mutation in BnaA.FAD2.a introduced by TALE nuclease pair BnFAD2_T02
cctctcctccctcaccctctctcctacttcgcctggcctctctactcggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgtgggacgcaccgtgaggttaacggttcagttcactctcggctggcctttgtacttag

SEQ ID NO: 17769 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 17770 - DNA, 394 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggacgccattgctggcgatggccaccacctgctggggggtcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17771 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcatacatcaagtggtacggcaagtacctcaacaaccctttgggacgcaccgtgatgttaacggttcagttcactctcggctggcctttgtacttag

SEQ ID NO: 17772 - DNA, 355 bp, Artificial
  Mutation in BnaA.FAD2.a introduced by TALE nuclease pair BnFAD2_T02
cctctcctccctcacccgctctcctacttcgcctggcctctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttctcctggagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcgggccgttgtacttag

SEQ ID NO: 17773 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtaagacatcaagtggtacggcaagtacctcaacaccccgttgggacgcaccgtgatgttaacggttcagttcactctcggctggcctttgtacttag

SEQ ID NO: 17774 - DNA, 381 bp, Artificial
  Mutation in BnaA.FAD2.a introduced by TALE nuclease pair BnFAD2_T02
cctctcctccccaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtctccagcggctgttgccggtgccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17775 - DNA, 359 bp, Artificial
  Mutation in BnaA.FAD2.a introduced by TALE nuclease pair BnFAD2_T02
cctctcctccctcaccctttcacttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacagccctttgggacgcaccgtgatgtgaacggttcagttcactctcggctggcctttgtacttag

SEQ ID NO: 17776 - DNA, 355 bp, Artificial
  Mutation in BnaA.FAD2.a introduced by TALE nuclease pair BnFAD2_T02
cctctcctccctcaccctctcacctacttcgcctggcctctctcctcggcctgccagggatgcgtcccacccggcgtctgggtcatagcccacgagtgcggccaccacgccttcagcgactaccagtggctggacgacaccgtcgtcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaaccgtccaggtcacgctcggctggcctttgcacttag

SEQ ID NO: 17777 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggaaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17778 - DNA, 336 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcatcgacgccaccattccaacactggctccctcgagagatacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17779 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctccttcatcgacgccaccattccaacactggctccctcgagagagacgaagtgtttgtccccaagaagaagtcagacatcaagtggtacggcaagtacctcaacaacccttggggacgcaccgtgattttaacggttcagttcactctcggctggcctttgtacttag

SEQ ID NO: 17780 - DNA, 356 bp, Artificial
  Mutation in BnaA.FAD2.a introduced by TALE nuclease pair BnFAD2_T02
cctctcctccctcaccctctcccttacctcgcctggcctctctactgggcctgccaagggtgcgtcctaaccggcctctgggtcatcgcccacgaatgcggccaccacgccttcagcgaccaccagtggctggacgacgccgtgggcctcgtcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17781 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17782 - DNA, 357 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17783 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 17784 - DNA, 346 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccgtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 17785 - DNA, 310 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17786 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatagccaacgagtgcggccaccacgccttcagcgactaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17787 - DNA, 357 bp, Artificial
  Mutation in BnaA.FAD2.a introduced by TALE nuclease pair BnFAD2_T02
cctctcctccctcaccctctctcctacttcgcctggcatctctactgggcctgccagggctgcgtcctaaccggcgtctgggtcatagcccacgagtgcggccaccacgccttcagcgactaccagtggcttgacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcatcgttaggttaacggttcagttcactctcggcgggcctttgtacttag

SEQ ID NO: 17788 - DNA, 336 bp, Artificial
  Mutation in BnaA.FAD2.a introduced by TALE nuclease pair BnFAD2_T02
cctctcctccctcaccctctctcctacttcgcctggcctctcttctgggcctgccagggctgcgtcctaaccggcgtctgggtcatagcccacgagtgcggccaccacgccttcagcgaccaccagtggctggacgacgccgtgggcctcgtcttccactccttcctcctcgtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 17789 - DNA, 335 bp, Artificial
  Mutation in BnaA.FAD2.a introduced by TALE nuclease pair BnFAD2_T02
cctctcctccctcaccctctcacttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttactcaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17790 - DNA, 416 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatctccagcgcctgcttgccgccatcgtggcccacggcttgaccccccagcaggtggtggcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17791 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 17792 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcaacttccactccttcctcctcgtcccttacttctcctggatcatcgacgccaccattccaacactggctccctcgagagagacgaagtgtttgtccccaagaagaagccagacatcacgtggtacggcaagtacctcaacatccctctgagacgcaccgtgatgtaaaccgttcagttcactctcggctggcctttgtacttag

SEQ ID NO: 17793 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcatcgacgccaccattctaacactggctccctcgagagagacgaagtgtttgtccccaagaagaagtcagacatcaagtggtacggcaagtacctcaacaacccttggggacgcaccgtgatgttaacggttcagttcgctctcggctggcctttgtacttag

SEQ ID NO: 17794 - DNA, 356 bp, Artificial
  Mutation in BnaA.FAD2.a introduced by TALE nuclease pair BnFAD2_T02
cctctcctccctcaccctctctcctacttcgcctggactctctactcggcctgccagggctgcgtcctaaccggcgtctgggtcatagcccacgagtgcggccaccacgccttcagcgactaccagtggctggacgacaccgtcggcctcatcttccactccttcctcctcggcccttacttctcctggaagtcaccgacgccaccattccaacactggctccctcgagagagacgaagtgtttgtccccaagaagaagtcagacatcgagtggtacggcaagtacctcaacaaccctttgggacgcgccgtgattttaacggttcgggtcactctcggctgcccttagtacttag

SEQ ID NO: 17795 - DNA, 396 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatggcggtggccaccacctgctggggggtcaagccgtgggcctggcacagcaccggcaacagccgctggaccctcgagagagacgaagtgtttgtccccaagaagaagtcagacatcaagtggtacggcaagtacctcaacaacccttggggacgcaccgtgatgttaactgttcagttcactctcggctggcctttgtacttag

SEQ ID NO: 17796 - DNA, 317 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggagagagacgaagtgtttgtccccaagaagaagtcagacatcaagtggtacggcaagtacctcaacaaccctttgggacgcaccgtgatgttaacggttcagttcactctcggctggcctttgtacttg

SEQ ID NO: 17797 - DNA, 362 bp, Artificial
  Mutation in BnaA.FAD2.a introduced by TALE nuclease pair BnFAD2_T02
ctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17798 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactcag

SEQ ID NO: 17799 - DNA, 351 bp, Artificial
  Mutation in BnaA.FAD2.a introduced by TALE nuclease pair BnFAD2_T02
cctctcctccctcaccctctctcctacttcgcctgtcctctctactcggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggatcgacgccaccattccaacactggctccctcgagagagacgaagtgtttgtccccaagaagaagtcagacatcaagtggtacggcaagtacctcaacagccctgtgggacgcaccgtgtgggtaacggttcaggtcactctcggcgggccgttttacttag

SEQ ID NO: 17800 - DNA, 323 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtaccgctcgccgcagccgaacgaccgagaagaagtcagacatcaagtggtacggcaagtacctcaacaaccctttgggacgcaccgtgatgttaacggttcagttcacgctcggctggcctttgtacttag

SEQ ID NO: 17801 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 17802 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 17803 - DNA, 426 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacacacgcgcacatcgttgcgttaagccaacacccggcagcgttagggaccgtcgctgtcaagtatcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17804 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17805 - DNA, 434 bp, Artificial
  Mutation in BnaA.FAD2.a introduced by TALE nuclease pair BnFAD2_T02
cctctcctccctcaccctttcccttacctcggctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatggcggcaagcaggcgctggagacggtccagcggctggtgccggtgctgtgccaggcccacggcttgaccccccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggctggcctttgtacttag

SEQ ID NO: 17806 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttaactctcggctggcctttgtacttag

SEQ ID NO: 17807 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtccattacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17808 - DNA, 346 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgaaaccgtcggcctcatcttccactccttcctcctcgtcccttacttctcctggagccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17809 - DNA, 383 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtttgaccccggagcaggtggtggccagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 17810 - DNA, 336 bp, Artificial
  Mutation in BnaA.FAD2.a introduced by TALE nuclease pair BnFAD2_T02
cctctcctccctcaccctctctcctacttcgcctggcctctctactggacctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17811 - DNA, 348 bp, Artificial
  Mutation in BnaA.FAD2.a introduced by TALE nuclease pair BnFAD2_T02
cctctcctccctcaccctctcacttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17812 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17813 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacaccggatccctcgagagggatgaagtgttcgtccccaagaagaagtcagacatcaagcggtacggaaagtacctcaacaacccgctaggacgcacggtgatgctaaccgtccagttcacgctcggctggcctttgtacttag

SEQ ID NO: 17814 - DNA, 358 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaccgggcctctgggtcatcgcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacagcccgttgggacgcaccgtgatgttaacggttcagttcactctcggctggcctttgtacttag

SEQ ID NO: 17815 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaccatgacgccaccattccaacaccggatccctcgatagggacgaagtgttcgtccccaagaagaagtcagacatcaagtggtacggcaagtacctcaacaaccctttgggacgcaccgtgatgttaacggttcagtgcactctcggctggcctttgtacttag

SEQ ID NO: 17816 - DNA, 356 bp, Artificial
  Mutation in BnaA.FAD2.a introduced by TALE nuclease pair BnFAD2_T02
cctctcctccctcaccctatcacctacttcgcctggccactctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 17817 - DNA, 354 bp, Artificial
  Mutation in BnaA.FAD2.a introduced by TALE nuclease pair BnFAD2_T02
cctctcctccctcaccctctctcctacttcgcctggccactctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctctgctggcctgtgtacttag

SEQ ID NO: 17818 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcacgctcggctggcctttgtacttag

SEQ ID NO: 17819 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17820 - DNA, 291 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggaagactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 17821 - DNA, 318 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17822 - DNA, 389 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaaggatctcaagaagatcctttgatcttttctacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17823 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttaagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17824 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtgggcctcgtcttccactccttcctcctcgtcccttacttctcctggaaagccatcgacgccaccattccaacaccggatccctcgagagggatgaagtgttcgtccccaagaagaagtcagacatcaagtggtacggcaagtacctcaacaacccgctaggacgcacggtgatgctaaccgtccagttcacgctcggctggcctttgtacttag

SEQ ID NO: 17825 - DNA, 340 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtccagtcatcaacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttgtacttag

SEQ ID NO: 17826 - DNA, 355 bp, Artificial
  Mutation in BnaA.FAD2.a introduced by TALE nuclease pair BnFAD2_T02
cctctcctccctcaccctctctcctacctcgcctggcccctctactgggcctgccaaggctgcgtcctaaccggcctctgggtcatagcccacgaatgcggccaccacgccttcagcgactaccagtggctggacgacgccgtcggcctcgtcttccactccttcctcctcgtcccttacttctcctggaagtatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17827 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcccggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcttggctggccgttgtccttag

SEQ ID NO: 17828 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 17829 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggcaaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17830 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggcctttgtacttag

SEQ ID NO: 17831 - DNA, 356 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 17832 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccttcatcgacgccaccattccaacactggctccctcgagagagacgaagtgtttgtccccaagaagaagtcagacatcaagtggtacggcaagtacctcaacaaccctttgggactcaccgtgatgttaacggttcagtgcactctcggctggcctttgtacttag

SEQ ID NO: 17833 - DNA, 416 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggatctccagcgcctgcttgccgccatcgtggcccacggcttgaccccccagcaggtggtggcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17834 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaggtggtactgcaagtacctcaacaaccctttgggacgcaccgtgatgttaacggttcagttcactctcggctggcctttgtacttag

SEQ ID NO: 17835 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaagtcatcgacgccaccattccaacactggctccctcgagagagacgaagtgtttgtccccaagaagaagtcagccatcaagtggtacggcaagtacctcaacaaccctttgggacgcaccgtgatgttaacggttcagttcactctcggctggcctttgtacttag

SEQ ID NO: 17836 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagcatcgacgccaccattccaacactggctccctcgagagagacgaagtgtttgtccccaagaagaagtcagacatcaagtggtacggcaagtacctcaacagccctttgggacgcaccgtgatgttaacggttcaattcactctcggctggcctttgtacttag

SEQ ID NO: 17837 - DNA, 363 bp, Artificial
  Mutation in BnaA.FAD2.a introduced by TALE nuclease pair BnFAD2_T02
cctctcctccctcaccctttctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17838 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgtgggacgcaccgtgatgttaactgttcagttcactctcggctggcctttgtacttag

SEQ ID NO: 17839 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 17840 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaaacatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 17841 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccgacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17842 - DNA, 358 bp, Artificial
  Mutation in BnaA.FAD2.a introduced by TALE nuclease pair BnFAD2_T02
cctctcctccctcaccctctcccttacctcgcctggcccctctactgggcctgtcaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17843 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 17844 - DNA, 392 bp, Artificial
  Mutation in BnaA.FAD2.a introduced by TALE nuclease pair BnFAD2_T02
cctctcctccctcaccctctcccttacctcgcctggcccctctcctgggcctgccaaggctgcgtcctaacgggcctctgggtcatagcccacgagtgcggccaccacgccttcagcgactaccagtggctggacgacaccgtcggtctcatcttccactccttcctcctcgtcccttacttctcctggagactgagcctttcgttttatctgttgtttgtcggtgaacgctcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 17845 - DNA, 351 bp, Artificial
  Mutation in BnaA.FAD2.a introduced by TALE nuclease pair BnFAD2_T02
cctctcctccctcaccctctcacctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17846 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgtggccaccacgccttcagcgaccaccagtggctggacgacgccgtgggcctcgtcttccactccttcctcctcgtcccttacttctcctggaagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17847 - DNA, 362 bp, Artificial
  Mutation in BnaA.FAD2.a introduced by TALE nuclease pair BnFAD2_T02
cctatcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17848 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 17849 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 17850 - DNA, 393 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacatgttctttcctgcgttatcccctgattctgtggatatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17851 - DNA, 356 bp, Artificial
  Mutation in BnaA.FAD2.a introduced by TALE nuclease pair BnFAD2_T02
cctctcctccctcaccctctctcctacttcgcctggcctctctcctgggcctgccaagggtgcgtcctaacgggcctctgggtcatcgcccacgaatgcggccaccacgccttcagcgaccaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 17852 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtatggcaagtacctcaacaaccctttgggacgcaccgtgatgttaacggttcagttcactctcggctggcctttgtacttag

SEQ ID NO: 17853 - DNA, 354 bp, Artificial
  Mutation in BnaA.FAD2.a introduced by TALE nuclease pair BnFAD2_T02
cctctcctccctcaccctctctcctacttcgcctggccactctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17854 - DNA, 348 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccttcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17855 - DNA, 355 bp, Artificial
  Mutation in BnaA.FAD2.a introduced by TALE nuclease pair BnFAD2_T02
cctctcctccctcaccctttcccttacctcgcctggccactctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctccgctggcctttgtacttag

SEQ ID NO: 17856 - DNA, 431 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaacattgctggcgatggccaccacctgctggggggtcaagccgtgggcttggcacagcaccggcaacagccgctggagtcatcgacgccaccattccaacactggctccctcgagagagacgaagtgtttgtccccaagaagaagtcagacatcaagtggtacggcaagtacctcaacaaccctttgggacgcacagtgatgttaacggttcagttcactctcggctggcctttgtacttag

SEQ ID NO: 17857 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatggtaacggttcagttcactctcggctggcctttgtacttag

SEQ ID NO: 17858 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcacgctccgccggcctttgtacttag

SEQ ID NO: 17859 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaccatgatgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 17860 - DNA, 358 bp, Artificial
  Mutation in BnaA.FAD2.a introduced by TALE nuclease pair BnFAD2_T02
cctctcctccctcaccctctcccctacttcgcctggcccctctacagggcctgccagggctgcgtcctaaccggcctctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaataagaagtcagacatcaagtggtacggcaagtacctcaacaaccctttgggacgcaccgtgatggtaacggttcagttcactctcggctggcctttgtacttag

SEQ ID NO: 17861 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcacggctggcctttgtacttag

SEQ ID NO: 17862 - DNA, 427 bp, Artificial
  Mutation in BnaA.FAD2.a introduced by TALE nuclease pair BnFAD2_T02
cctctcctccatcaccctctctcctacttcgcctggcatctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctccagcgcctgcttgccaccattattgctggcgatggccaccacctgctggggggtcaagccgtgggcctggcacagcacctggacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggccttttacttag

SEQ ID NO: 17863 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17864 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 17865 - DNA, 423 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttactttccagcgcctgcttgccgccatcgtggctggcgatggccaccacctgctggggggtcaagccgtgggcctggcacagtcatcgacgccaccattccaacaccggatccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 17866 - DNA, 356 bp, Artificial
  Mutation in BnaA.FAD2.a introduced by TALE nuclease pair BnFAD2_T02
cctctcctccctcacctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17867 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttccgtcatcgacgccaccattccaacactggctccctcgagagagacgaagtgtttgtccccaagaagaagtcagacatcaagtggtacggcaagtacctcaacaaccctttgggacgcaccgtgatgttaacggttcaattcactctcggctggcctttgtacttag

SEQ ID NO: 17868 - DNA, 354 bp, Artificial
  Mutation in BnaA.FAD2.a introduced by TALE nuclease pair BnFAD2_T02
cctctcctccctcaccctctcccttacctcgcctggcccctctactgggccttccaaggctgcgtcctaacgggcctctgggtcatcgcccacgaatgcggccaccacgccttcagcgaccaccagtggctggacgacgccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggccttgtacttag

SEQ ID NO: 17869 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaggcctgcgtcctaaccggcgtctgggtcatagcccacgagtgcggccaccacgccttcagctactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcacgtacctcaacaaccctgtggtacgcgccgtgatgttaacggttcagtccactctccgcaggccgttgtacttag

SEQ ID NO: 17870 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacatcgacgccaccattccaacactggctccctcgagagagacgaagtgtttgtccccaagaagaagtcagacatcaagtggtacggcaagtacctcaacaaccctgtgggacgcaccgtgatgttaacggttaagttcactctcggctggcctttgtacttag

SEQ ID NO: 17871 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgatgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17872 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 17873 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 17874 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggcttgacgacaccgtcggcctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctctgctggcctttgtacttag

SEQ ID NO: 17875 - DNA, 351 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggctggacgacaccgtcggcctcatcttccactccttcctcctcgtcccttacttctcctgcatcgacgccaccattccaacaccggatccctcgagagggatgaagtgttcgtccccaagaagaagtcagacatcaagtggtacggcaagtacctcaacaaccctttgggacgcaccgtgatgttaacggttcagtgcactctcggcgggcctttgggcttag

SEQ ID NO: 17876 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17877 - DNA, 356 bp, Artificial
  Mutation in BnaA.FAD2.a introduced by TALE nuclease pair BnFAD2_T02
cctctcctccctcaccctctcgcttacctcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaactacctcagcaaccgttgtggacgcaccgtgatgttaacggttcagttcattctccgctggccattgtacttag

SEQ ID NO: 17878 - DNA, 353 bp, Artificial
  Mutation in BnaA.FAD2.a introduced by TALE nuclease pair BnFAD2_T02
cctctcctccctcaccctttctcctacttcgcctggcctctctactaggcctgccagggctgcgtcctaaccggcgtctgggtcatagcccacgagtgcggccaccacgccttcagcgactaccagtggctggacgacaccgtcgacctcatcttccactccttcctcctcgtcccttaattctcctggacatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcgtctggcctgtgtacttag

SEQ ID NO: 17879 - DNA, 346 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggcctcatcttccactccttcctcctcgtcccttacttctcctggcgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17880 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 17881 - DNA, 431 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaacattgctggcgatggccaccacctgctggggggtcaagccgtgggcctggcacagcaccggcaacagccgctggagtcatcgacgccaccattccaacacttgctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17882 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggatgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgctaaccgtccagttcacgctcggctggcctttgtacttag

SEQ ID NO: 17883 - DNA, 356 bp, Artificial
  Mutation in BnaA.FAD2.a introduced by TALE nuclease pair BnFAD2_T02
cctctcctccctcaccctctcccttacctcgcctggccactctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtgcggcaagtacctcaacacccctgtgggacgcaccgtgatgttaacggttcagttcactctcggctggcctttgtacttag

SEQ ID NO: 17884 - DNA, 355 bp, Artificial
  Mutation in BnaA.FAD2.a introduced by TALE nuclease pair BnFAD2_T02
cctctcctccctcaccctttctcctacttcgcctggcttctctcctgggcctgccagggctgcgtcccaaccggcgtctgggtcatagctcacgagtgcggccaccgcgccttcagcgactaccagtggctggacgacaccgtcggccgcatcttccactccttcctcctcgtcccttacttctcctggaatcatcgacgccaccattccaacactggctccctcgagagagacgaagtgtgtgtccccaagaagaagtcagacatcgagtggtacggcaagtacctcaacaaccctttgggacgcgccgtgatgttaacggttcagttcactctcggctgccctttgtacttag

SEQ ID NO: 17885 - DNA, 357 bp, Artificial
  Mutation in BnaA.FAD2.a introduced by TALE nuclease pair BnFAD2_T02
cctctcctccctcaccctctctcctacttcgcctggccactctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17886 - DNA, 312 bp, Artificial
  Mutation in BnaA.FAD2.a introduced by TALE nuclease pair BnFAD2_T02
cctctcctccctcaccctatctcctacttcgcctggcctctctactgggcctgccagggctgcgtcctaaccggcgtctgggtcatagcccacgagtgcggccaccacgccttcagcgactaccagtggctggacgacaccgtcggtctcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 17887 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttactactcctagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17888 - DNA, 274 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccattccaacaccggatccctcgagagggatgaagtgttcgtccccaagaagaagtcagacatcaagtggtacggcaagtacctcaacaaccctttgcgacgcaccgtgatgttaacggttcagttcactctcggctggcctttgtacttag

SEQ ID NO: 17889 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatgtcatcgacgccaccattccaacactggctccctcgggagagacgaagtgtttgtccccaagaagaagtcagacatcaagtggtacggcaagtacctcaacaaccctttgggacgcaccgtgatgtgaacggttcagttcactctcggctggcctttgtacttag

SEQ ID NO: 17890 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaattacctcaacaaccctttgggacgcaccgtgatgttaacggttcagttcacgctcggctggcctttgtacttag

SEQ ID NO: 17891 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgaatgcggccaccacgccttcagcgaccaccagtggctggacgacgccgtgggcctcgtcttccactccttcctcctcgtcccttacttctcctggaaagtggctccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17892 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctggatcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17893 - DNA, 353 bp, Artificial
  Mutation in BnaA.FAD2.a introduced by TALE nuclease pair BnFAD2_T02
cctctcctccatcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 17894 - DNA, 357 bp, Artificial
  Mutation in BnaA.FAD2.a introduced by TALE nuclease pair BnFAD2_T02
cctctcctccctcaccctttctcctacttcgcctggcctctctactgggcctgccagggctgcgtcctaaccggcgtctgggtcatcgcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtgcctcaacaaccttttgggacgcaccgtgatgttaacggtgcagttcactctcggctggcctttgtacttag

SEQ ID NO: 17895 - DNA, 345 bp, Artificial
  Mutation in BnaA.FAD2.a introduced by TALE nuclease pair BnFAD2_T02
cctctcctccctcaccctgtatcctacttcgcctggcctctctactgggcctgccaagggcgcgtcctaaccggcctctgggtcatcgcccacgagtgcggccaccacgccttcagcgactaccagtggctggacgacaccgtcggcctcatcttccactccttcctcctcttcccttacttcatcgacgccaccattccaacactggctccctcgagagagacgaagtgtttgtccccaagaagaagtcagacatcaagtggtacggcaagtacctaagcagccctgtgggacgcaccgtgaggttaacggttcagttgactcccggctggcctttgtacttag

SEQ ID NO: 17896 - DNA, 345 bp, Artificial
  Mutation in BnaA.FAD2.a introduced by TALE nuclease pair BnFAD2_T02
cctctcctccctcaccctctcccttacctcgcctggcccctctcctgggcctgccaaggctgcgtcctaacgggcctctgggtcatcgcccacgaatgcggccaccacgccttcagcgactaccagtggctggacgacaccgtcggcctcatcttccactccttcctcctcgtcccttacttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17897 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcgggcctttgtacttag

SEQ ID NO: 17898 - DNA, 356 bp, Artificial
  Mutation in BnaA.FAD2.a introduced by TALE nuclease pair BnFAD2_T02
cctctcctccctcaccctctctcctacttcgcctggcctctttactgggcctgccagggctgcgtcctaaccggcgtctgggtcatagcccacgagtgcggccaccacgccttcagcgactaccagtggctggacgacaccgtcggcctaatcttccactccttcctcctcgtcccttacttctcctggaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 17899 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtacacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 17900 - DNA, 347 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggtctcatcttccactccttcctcctcgtcccttacttctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17901 - DNA, 332 bp, Artificial
  Mutation in BnaA.FAD2.a introduced by TALE nuclease pair BnFAD2_T02
cctctcctccctcaccctgtctcttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaactggctccctcgagagagacgaagtgtttgtccccaagaagaagtcagacatcaagtggtacggcaagtacctcaacaaccctgtgggacgcaccgtgatgttaacggttcagttcactctcggctggcctttatacttag

SEQ ID NO: 17902 - DNA, 349 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttaatcgtgtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggccgttgtacttag

SEQ ID NO: 17903 - DNA, 345 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagttgctggacgacgccgtgggcctcgtcttccactccttcctcctcgtcccttacttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17904 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagttgctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17905 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 17906 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 17907 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17908 - DNA, 353 bp, Artificial
  Mutation in BnaA.FAD2.a introduced by TALE nuclease pair BnFAD2_T02
cctctcctccctcaccctctctcctacttcgcctggcccctctactcggcctgccagggctgcgtcctaaccggcgtctgggtcatagcacacgagtgcggccaccacgccttcagcgactaccagtggcttgacgacaccgtcggtctcatcttccactccttcctcctcgtcccttacttctccttgtcatcgacgccaccattccaacactggctccctcgagagagacgaagtgtttgtccccaagaagaagtcagacatcaagtggttcggcaagtagctcaacaacccttatggacgcacggggatgttaacggttcagttccctctcggctggcctttgtacttag

SEQ ID NO: 17909 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatcgcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcacgctcggctggcctttgtacttag

SEQ ID NO: 17910 - DNA, 455 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaccgtctccagcgcctgcttgccaccattattgctggcgatggccaccacctgctggggggtcaagccgtgggcctggcacagcaccggcaacagccgcttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17911 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggatgcgtcctaacgggcctctgggtcatcgcccacgaatgcggccaccacgccttcagcgaccaccagtggctggacgacgccgtgggcctcgtcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17912 - DNA, 357 bp, Artificial
  Mutation in BnaA.FAD2.a introduced by TALE nuclease pair BnFAD2_T02
cctctcctccctcaccctatctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17913 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17914 - DNA, 332 bp, Artificial
  Mutation in BnaA.FAD2.a introduced by TALE nuclease pair BnFAD2_T02
cctctcctccctcaccctctctcctacttcgcctgccccctctactcggcctgccaaggctgcgtcctaacggccctctgggtcatcgcccaccaatgcggccaccacgccttcagcgaccaccagtggctggacgacgccgtgggcctcgtcttccactccttcctcctcgtcccttacttctcctggaagtggctccctcgagagagacgaagtgtttgtccccaagaagaagtcagacatcaagtggtacggcaagtacctcaacatccctttgggaggcaccgtgatgtaaacggttcagttcacgctcggcgggcctttgtacttag

SEQ ID NO: 17915 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactcctccctcctcgtcccttacttctcctggaaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17916 - DNA, 358 bp, Artificial
  Mutation in BnaA.FAD2.a introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 17917 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccataatgttaacggttcagttcactctcggctggcctttgtacttag

SEQ ID NO: 17918 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggctggacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17919 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17920 - DNA, 312 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcgacgccaccataccaacaccggatccctcgagagggatgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 17921 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcctctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17922 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtcggcctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17923 - DNA, 355 bp, Artificial
  Mutation in BnaA.FAD2.a introduced by TALE nuclease pair BnFAD2_T02
cctctcctccctcaccctatcacttacctcgcctggccactctactgggcctgccaaggctgcgtcctaccgggcctctgggtcatcgcccacgaatgcggccaccacgcattcagcgaccaccagtggctggacgacgccgtgggcctcgtcttccactccttcctcctcgtcccttacttctcctggagtcatcgacgccaccattccaacacgggctccctcgagagagacgaagtgtttgtccccaagaagaagtcggacaacaagtggtacggcaagtacctcaacaaccttttgggacgcaccgtgatgttaacggttcagttcactctcggcgtgccggtgtacttag

SEQ ID NO: 17924 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 17925 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacacccctttgggacgcaccgtgatgttaacggttcagttcactctcggctggcctttgtacttag

SEQ ID NO: 17926 - DNA, 402 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggactgccgctgccaagttcgagagacagcacatggacagcatcgatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17927 - DNA, 357 bp, Artificial
  Mutation in BnaA.FAD2.a introduced by TALE nuclease pair BnFAD2_T02
cctctcctccctcaccctctctcctacttcgcctggcatctctcctgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17928 - DNA, 358 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17929 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccatcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17930 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggcctcatcttccactccttcctcctcgtcccttacttctcctggacagtcatcgacgccaccattccaacactggctccctcgagagagacgaagtgtttgtccccaagaagaagtcagacatccagtggtacggcaagtacctcaacaaaccctttggaccgcccgttgtgtttacggttcagttcactctcggctggcctttgtacttag

SEQ ID NO: 17931 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17932 - DNA, 323 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacgccgtcggcctcctcttccactccttcctcctcgtcccttacttctcctggaagtaccgctcgccgcagccgaacgaccgagaagaagtcagacgtcaagtggtacggcaagtacctcaacaaccctttgggacgcaccgtgatgttaacgggtcagttcactctcggctggcctttgtacttag

SEQ ID NO: 17933 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17934 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtcaccaagaagaagtcagacatcaggcggtacggcaagtacctcaacaaccctttgggacgcaccgtgatgttaacggttcagttcactctcggctggcctttgtacttag

SEQ ID NO: 17935 - DNA, 350 bp, Artificial
  Mutation in BnaA.FAD2.a introduced by TALE nuclease pair BnFAD2_T02
cctctcctccctcaccctctcccttacctcgcctggcccctccaccgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctagtcatcgacgccaccattccaacactggctccctcgagagagacgaagtgtttgtccccaagaagaagtcagacatcaagtggtacggcaagtacctcaacaaccctttgggacgcaccgtggtgttaacggttcagttcacgctcggctggcctttgtgcttag

SEQ ID NO: 17936 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17937 - DNA, 355 bp, Artificial
  Mutation in BnaA.FAD2.a introduced by TALE nuclease pair BnFAD2_T02
cctctcctccctcaccctctcccttacctcgcctggcctctctactgggcctgccaaggctgcgtcctaccgggcctctgggtcatcgcccacgaatgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcagccatcaagtggtacggcaagtaccgcaacaaccctttggtactcaccgtgatgttatcggttcagttctctctcgggtggcctttgtacttag

SEQ ID NO: 17938 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttgtacttag

SEQ ID NO: 17939 - DNA, 360 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcagtcatcgacgccaccattccaacactggctccctcgagagagacgaagtgtttgtccccaagaagaagtcagacatcaagtggtacggcaaagacctcaacaacccgttggatcgcaccgggatgttaacgtttcatttcactctcgggtggcctgtgtacttag

SEQ ID NO: 17940 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgactaccagtggctggacgacaccgtcggcctcatcttccactccttcctcctcgtcccttacttctcctggaaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17941 - DNA, 344 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17942 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcatgtacctcaacaacccttggggacgcaccgtgatgttaacggttcagttcactctcggctggcctttgtacttag

SEQ ID NO: 17943 - DNA, 372 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttactcaagtcagaggtggcgaaacccgacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17944 - DNA, 344 bp, Artificial
  Mutation in BnaA.FAD2.a introduced by TALE nuclease pair BnFAD2_T02
cctctcctcctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17945 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 17946 - DNA, 358 bp, Artificial
  Mutation in BnaA.FAD2.a introduced by TALE nuclease pair BnFAD2_T02
ctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17947 - DNA, 291 bp, Artificial
  Mutation in BnaA.FAD2.a introduced by TALE nuclease pair BnFAD2_T02
cctctcctccctcaccctgtctcctacttcgcctggcctctctactgggcctgccagggctgcgtcctaaccggcgtctgggtcatagcccacgagtgcggccaccacgccttcagcgactaccagtggcttgacgacaccgtcggaagactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17948 - DNA, 358 bp, Artificial
  Mutation in BnaA.FAD2.a introduced by TALE nuclease pair BnFAD2_T02
cctcccctccctcaccctctcacttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17949 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcgtcgcccacgactgcggccaccacgccttcagcgactaccagtggctggacgacaccgtcggcctcatcttccactccttcctcctcgtcccttacttctcctggaagtaagtcatcgacgccaccattccaacaccggctccctcgagagagacgaagtgtttgtccccaagaagaagtcagacatcaagtagtacggcaagtaccgcaacaaccatttgggacgcaccgtgatgttaacggttcagttcactctcggctggccttagtacttag

SEQ ID NO: 17950 - DNA, 356 bp, Artificial
  Mutation in BnaA.FAD2.a introduced by TALE nuclease pair BnFAD2_T02
cctctcctccctcaccctctctcctacttcgcctggcctccctactgggcctgccagggctgcgtcctaaccggcgtctgggtcatagcccacgagtgcggccaccacgacttcagcgactaccagtggctggacgacaccgtcggcctcatcttccactccttcctcctcgtcccttgcttctcctggaaatcatcgacgccaccattccaacactggctccctcgagagagacgaagtgtttgtccccaagaagaagtcagacatcaagtggtacggcaaggacctcaacaaccctttgggtcgcaccgtgatgttaacgtttcagttcacacgcggctggcctgagtacttag

SEQ ID NO: 17951 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacatcgacgccaccattccaacactggctccctcgagagagacgaagtgtttgtccccaagaagaagtcagccatcaagtggtacggcaagtacctcaacaaccctttgggacgcaccgtgatgttaacggttcagttcactctcggctggcctttgtacttag

SEQ ID NO: 17952 - DNA, 419 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacattccgtggcgttatccagctaagcgcgaactgcaatttggagaatggcagcgcaatgacacatcgacgccaccattccaacacgggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17953 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaaggacctcaacaaccctttgggacgcaccgtgatgttaacggttcagttcactctcggctggcctttgtacttag

SEQ ID NO: 17954 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17955 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgtggccaccacgccttcagcgactaccagtggctggacgacaccgtcggcctcatcttccactccttcctcctcgtcccttacttctcctggaagagtcatcgacgccaccattccaacactggcttcctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17956 - DNA, 448 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatccaagataagcctgtctagcttcaagtatgacgggctgacttggacaagaagaagatcgcttggcctcgcgcgcagatcagttggatacagtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 17957 - DNA, 357 bp, Artificial
  Mutation in BnaA.FAD2.a introduced by TALE nuclease pair BnFAD2_T02
cctctcctccctcaccctctcccttacctcgcctggcctctctactgggcctgtcagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17958 - DNA, 383 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagactgagcctttcgttttatttgatgcgtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcactctcggctggcctttgtacttag

SEQ ID NO: 17959 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 17960 - DNA, 355 bp, Artificial
  Mutation in BnaA.FAD2.a introduced by TALE nuclease pair BnFAD2_T02
cctctcctccctcacccactcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgtcctttgtacttag

SEQ ID NO: 17961 - DNA, 419 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacattccgtggcgttatacagctaagcgcgaactgcaatttggagaatggcagcgcaatgacacatcgacgccaccattccaacactggctccctcgagagagacgaagtgtttgtccccaagaagaagtcagacatcaagtggtacggcaagtacctcaacaaccctttgggactcaccgtgatgttaacggttcagtgcactctcggctggcctttgtacttag

SEQ ID NO: 17962 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagtttactctcggctggcctttgtacttag

SEQ ID NO: 17963 - DNA, 344 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttcctcatcgacgccaccattccaacactggctccctcgagagagacgaagtgtttgtccccaagaagaagtcagacatcaagtggtacggcaagtacctcaacacccctgtgggacgcaccgtgctgctaacggttcagttcactctcggctggcctttgtacttag

SEQ ID NO: 17964 - DNA, 417 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtggagcggatttgtcctactcaggagagcgttcaccgacaaacaacagataaaacgaaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17965 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17966 - DNA, 358 bp, Artificial
  Mutation in BnaA.FAD2.a introduced by TALE nuclease pair BnFAD2_T02
cctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17967 - DNA, 343 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtccctacttatcgacgccaccattccaacactggctccctcgagagagacgaagtgtttgtccccaagaagaagtcagacatcaagtggtacggcaagtgcctcaacaaccctttgggacgcaccgtgatgttaacggttcagttcactctcggctggcctttgtacttag

SEQ ID NO: 17968 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaacccgttggaacgcaccgtgatgttaacggttcatttcactctcggctagcctgtgtacttag

SEQ ID NO: 17969 - DNA, 458 bp, Artificial
  Mutation in BnaA.FAD2.a introduced by TALE nuclease pair BnFAD2_T02
cctctcctccctcaccctctctcctacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagaccgtccccagcgcctgcttgccgccatcgtggctggcgatggccaccacgtgctaacgcaaaaaggccatccgtcaggatggccttctgcttagtcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17970 - DNA, 393 bp, Artificial
  Mutation in BnaA.FAD2.a introduced by TALE nuclease pair BnFAD2_T02
cctctcctcctcaccctctctcctacttcgcctggcctctctactgggcctgccagggctgcgtcctaaccggcgtctgggtcatagcccacgagtgcggccaccatgccttcagcgactaccagtggctggacgacaccgtcggcctcatcttccactccttcctcctcgtcccttacttctcctggaagtattgagtgagctgataccgctcgccgcagccgaacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 17971 - DNA, 427 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacaaggcggtaatacggttatccacagaatcaggggataacgatatcgatgctgtccatgtgctgtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17972 - DNA, 349 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17973 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaacacgccttcagcgaccaccagtggctggacgacgccgtgggcctcgtcttccactccttcctcctcgtcccttacttctcctggaaagccatcgacgccaccattccaacactgactccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17974 - DNA, 330 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17975 - DNA, 348 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctccttcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17976 - DNA, 339 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctccaccatttcaacactggcttcctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17977 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcgtagcccacgagtgcggccaccacgccttcagcgactaccagtggctggacgacaccgtcggcctcatcttccactccttcctcctcgtcccttacttctcctggaagtcagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 17978 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 17979 - DNA, 310 bp, Artificial
  Mutation in BnaA.FAD2.a introduced by TALE nuclease pair BnFAD2_T02
cctctcctccctcaccctctcctacttcgcctggcctctctactgggcctgccagggctgcgtcctaaccggcgtctgggtcatagcccacgagtgcggccaccacgccttcagcgactaccagtggctggacgacaccgtcggcctcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 17980 - DNA, 350 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctagtcatcgacgccaccattccaacactggctccctcgagagagacgaagtgtttgtccccaagaagaagtcagacatcaagtggtacggcaagtacctcaacaacccgctaggacgcacggtgatgctaaccgtccaggtcacgctcggctggcctttgtacttag

SEQ ID NO: 17981 - DNA, 340 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtccctcatcgacgccaccattccaacactggctccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 17982 - DNA, 355 bp, Artificial
  Mutation in BnaA.FAD2.a introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 17983 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggatggcctttgtacttag

SEQ ID NO: 17984 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttccacctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17985 - DNA, 358 bp, Artificial
  Mutation in BnaA.FAD2.a introduced by TALE nuclease pair BnFAD2_T02
cctctcctccctcaccctgtctcctacttcgcctggcctctctactgggcctgccagggctgcgtcctaaccggcgtctggatcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17986 - DNA, 274 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttagtacttag

SEQ ID NO: 17987 - DNA, 336 bp, Artificial
  Mutation in BnaA.FAD2.a introduced by TALE nuclease pair BnFAD2_T02
cctctcctccctcaccctctctcctacttcgcctggccactctactgggcctgccaagggtgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggtcgcaccgtgatgttaacgtttcatttcactctcggctggcctgtgtacttag

SEQ ID NO: 17988 - DNA, 415 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtacggccaccacgccttcagcgactaccagtggctggacgacaccgtcggcctcatcttccactccttcctcctcgtcccttacttctcctggaagactgggcctttcgttttatctgggtccagcggctgttgccggtgctgtgccaggcccagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 17989 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaaatccgacatcaagtggtacggaaagtacctcaacaacccgctaggacgcacggtgatgttaacggttcagttcactctcggcgggcctgtgtacttag

SEQ ID NO: 17990 - DNA, 351 bp, Artificial
  Mutation in BnaA.FAD2.a introduced by TALE nuclease pair BnFAD2_T02
cctctcctccctcaccctctctcctacttcgcctggccactctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccatcatcgacgccaccattccaacactggctccctcgagagagacgaagtgtttgtccccaagaagaagtcagacatcaagtggtacggcaagtaccgctacaacccgttgggacgcaccgtgatgttatcggttcagttgactttcggctggccggtgtacttag

SEQ ID NO: 17991 - DNA, 351 bp, Artificial
  Mutation in BnaA.FAD2.a introduced by TALE nuclease pair BnFAD2_T02
cctctcctccctcaccctctcacttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17992 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17993 - DNA, 357 bp, Artificial
  Mutation in BnaA.FAD2.a introduced by TALE nuclease pair BnFAD2_T02
cctctcctccctcaccctctctcctacttcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 17994 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaaggacctcaacaaccctttgggacgcaccgtgatgttaacggttcagttcactctcggctggcctttgtacttag

SEQ ID NO: 17995 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 17996 - DNA, 357 bp, Artificial
  Mutation in BnaA.FAD2.a introduced by TALE nuclease pair BnFAD2_T02
cctctcctccctcaccctatctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcgccgtgttgttaacggttcagttcactctcggcgggccgttttacttag

SEQ ID NO: 17997 - DNA, 359 bp, Artificial
  Mutation in BnaA.FAD2.a introduced by TALE nuclease pair BnFAD2_T02
cctctcctccctcaccctctctcctacttcgcctcgcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttgtcatcgacgccaccattccaacactggctccctcgagagggatgaagtgttcgtccccaagaagaaatccgacatcaagtggtacggcaagtacctcaacaaccctttgggacgcaccgtgatgttaacggttcagttcacgctcggctggcctttgtacttag

SEQ ID NO: 17998 - DNA, 379 bp, Artificial
  Mutation in BnaA.FAD2.a introduced by TALE nuclease pair BnFAD2_T02
cctctcctccctcaccctctctcctacttcgcctggcctctctccccggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggctccgcccccctgacgagcatcacagtcatcgacgccaccattccaacactggctccctcgagagagacgaagtgtttgtccccaagaagaagtcagacatcaagtggtacggcaagtacctcaacaaccctttgggacgcaccgtggggttaacggttcaggtcaggctcggctggcctttgtacttag

SEQ ID NO: 17999 - DNA, 350 bp, Artificial
  Mutation in BnaA.FAD2.a introduced by TALE nuclease pair BnFAD2_T02
cctctcctccctcaccctatctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 18000 - DNA, 357 bp, Artificial
  Mutation in BnaA.FAD2.a introduced by TALE nuclease pair BnFAD2_T02
cctctcctccctcaccctctctcctacttcgcctggcctctctaatgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccgccattccaacactggctccctcgagagagacgaagtgtttgtccccaagaagaaagccgacatcaagtggtacggaaagtaccgcaacaacccgctaaagcgcacggtgatgctatccagcgagttctcgctcggctggccgttgtacttag

SEQ ID NO: 18001 - DNA, 332 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18002 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18003 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgaccccgtcggcctcatcttccactccttcctcctcgtcccttacttctcctggaagtagtcatcgacgccaccattccaacaccggctccctcgagagagacgaagtgtttgtccccaagaagaagtcagacatcaagtggtacggcaagtacctcaacaacccgttgggacgcaccgtgatgttaaccgttcagttcactctcggctggcctttgtacttag

SEQ ID NO: 18004 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcggcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18005 - DNA, 378 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttccactccttacttactcgtcccctacaacctgcccatcggccaggccgacgccatcgacgccaccattccaacaccggattcctcgagagagacgaagtgtttgtccccaagaagaagtcagacatcaagtggtacggcaagtacctcaacaacccgctaggacgcacggtgatgctaaccgtccagttcacgctcggctggccttggtactta

SEQ ID NO: 18006 - DNA, 366 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacaatcagaaaaggtccactgggttcgtgccttccaccattccaacactggctccctcgagagagacgaagtgtttgtccccaagaagaaatccgacatcaagtggtacggaaagtacctcaacaaccctttgggacgcaccgtgatgttaacggttcagttcactctcggctggcctttgtacttag

SEQ ID NO: 18007 - DNA, 382 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctgggtcaagttgagcggggcacccgtcagtgcattgcgccatgcaggcggcaagcaggcgctggagacagtcatcgacgccaccattccaacaccggatccctcgagagggatgaagtgttcgtccccaagaagaaatccgacatcaagtggtacggcaagtacctcaacacccctttgggacgcaccgtgatgttaacggttcagttcactctcggctggcctttgtgcttag

SEQ ID NO: 18008 - DNA, 383 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaacgaacaggtcactatcagtcaaaataaaatcccgcgcgtttgccgattcattaatgcagctggcacgacaggtttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18009 - DNA, 407 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgccgacaccgtcggtctcctcttccactccttcctcctcgtcccttacttctcctggaagtacggtgctgttccgggcgagctcgatcagctcgatgtcctcgtgggacagtcatcgacgccaccattccaacactggctccctcgagagagacgaagtggttgcccccaagaagaaggcagacatcaagtggtacggcaggtacctcagcaaccctctgggacgccccgggaggttaacgtttcagttgactcgcggctgccctgagtacttag

SEQ ID NO: 18010 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaattcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctgtgtacttag

SEQ ID NO: 18011 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18012 - DNA, 359 bp, Artificial
  Mutation in BnaA.FAD2.a introduced by TALE nuclease pair BnFAD2_T02
cctctcctccctcaccctctctcctactacgcctggccactctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaccccgttgggacgccccgggccgttaccggttcatttcactctcggctggcctttgtacttag

SEQ ID NO: 18013 - DNA, 358 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18014 - DNA, 393 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtacaacactggctccctcgagagagacgaagtgtttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18015 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttcatcgacgccaccattccaacactggctccctcgagagagacgaagtgtttgtccccaagaagaagtcagacatcaagtggtaaggcaagcatcgcaaccgtccgttgggaagaaccgtgatgtcaacggttcagtgtgctctcggctggccttagtacttag

SEQ ID NO: 18016 - DNA, 341 bp, Artificial
  Mutation in BnaA.FAD2.a introduced by TALE nuclease pair BnFAD2_T02
cctctcctccatcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtccagtcatcgacgccaccattccaacactggctccctcgagagagacgaagtgtttgtccccaagaagaagtcagacatcaagtggtacggcaagtacctcaacaaccctctgggacgcaccgtgaggttaacggttcagttcactctcggctggcctttgtacttag

SEQ ID NO: 18017 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacacccctgtgggacgcaccgtgatgttaacggttcagttcactctcggctggcctttgtacttag

SEQ ID NO: 18018 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaagcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18019 - DNA, 315 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcataacgggcctctgggtcatcgcccacgaatgcggccaccacgccttcagcgaccaccaatggcggtggcaagcaggcgctggagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18020 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18021 - DNA, 403 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtatctccagcgcctgcttgccaccgccattgctggcgatggccaccagtcatcgacgccaccatgccaacaccggatccctcgagagggatgaagtgttcgtccccaagaagaaatccgacatcaagtggtacggaaagtacctcaacaacccgctagtacgcacggtgatgctaaccgtccagttcacgctcggctgcccgatgtactag

SEQ ID NO: 18022 - DNA, 332 bp, Artificial
  Mutation in BnaA.FAD2.a introduced by TALE nuclease pair BnFAD2_T02
cctctcctccctcaccctctctcctacttcgcctggcccctctactgggcctgtcagggctgcgtcctaaccggcgtctgggtcatagcccacgagtgcggccaccacgccttcagcgaccaccagtggcttgacgacaccgtcggcctcatcttccactccttcctcctcgtcccttacttctcctggaagtggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18023 - DNA, 355 bp, Artificial
  Mutation in BnaA.FAD2.a introduced by TALE nuclease pair BnFAD2_T02
cctctcctccctcaacctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18024 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccaggaatgcggccaccacgccttcagcgaccaccagtggctggacgacgccgtgggcctcgtcttccactccttcctcctcgtcccttacttctcctggaactcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18025 - DNA, 339 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 18026 - DNA, 352 bp, Artificial
  Mutation in BnaA.FAD2.a introduced by TALE nuclease pair BnFAD2_T02
cctctcctccctcaccctctctcctacttcgcctggccactctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggcatcgacgccaccattccaacactggctccctcgagagagacgaagtgtttgtccccaagaagaagtcagacatcaagtggtacggcaagtacctcaacaaccctttgggacgcaccgtgatgttaacgtttcagttcactctcggctggcctgtgtacttag

SEQ ID NO: 18027 - DNA, 352 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaatcgacgccaccattccaacactggctccctcgagagagacgaagtgtttgtccccaagaagaagtcagacatcaagtggtacggcaagtacctcaacaaccctttgggacgcaccgtgatgttaacggttcaattcactctcggctggcctttgtacttag

SEQ ID NO: 18028 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactctctccctcgagagagacgaagtgtttgtccccaagaagaagtcagacatcaagtggtccggcaaggacctcaacaaccctttgggacgcaccgtgatgttaacggttcagttcactctcggctgtcctttgtacttag

SEQ ID NO: 18029 - DNA, 389 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacagcaacgtcggttcgagatggcgctcgaagtcatcgacgccaccattccaacactggctccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 18030 - DNA, 355 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcgagtggtacggcaagtacctcaacaaccctttgggacgcaccgtgatgttaacggttcagttcactctcggctggcctttgtacttag

SEQ ID NO: 18031 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccccgccttcagcgaccaccagtggctggacgacgccgtgggcctcgtcttccactccttcctcctcgtcccttacttctcctggaagtacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactatcggctggcctttgtacttag

SEQ ID NO: 18032 - DNA, 330 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 18033 - DNA, 356 bp, Artificial
  Mutation in BnaA.FAD2.a introduced by TALE nuclease pair BnFAD2_T02
cctctcctccctcaccctctcccttacctcgcctggcccccctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggccattgtacttag

SEQ ID NO: 18034 - DNA, 355 bp, Artificial
  Mutation in BnaA.FAD2.a introduced by TALE nuclease pair BnFAD2_T02
cctctcctccctcaccctctcacttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgccccgtgatgttaacggttcagttcactctcggctggcctttgtacttag

SEQ ID NO: 18035 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttacactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18036 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 18037 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 18038 - DNA, 333 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcatcgacgccaccattccaacaccggatccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 18039 - DNA, 378 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatatggcggcaagcaggcgatggagtcatcgacgccaccattccaacactggctccctcgagagagacgaagtgtttgtccccaagaagaaatccgacatcaagtggtacggcaagtacctcaacaaccctttgggacgcaccgtgatgttaacggttcagttcacgctcggctggcctttgtacttag

SEQ ID NO: 18040 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttcaactccttcctcctcgtcccttacttctcctggaaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18041 - DNA, 355 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18042 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18043 - DNA, 394 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaagtgccaccattattgctggcgatggccaccacctgctagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18044 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcgtagcccacgagtgcggccaccacgccttcagcgactaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaaggaccgcaacacccctttgggacgcaccgtgatgttaacgggtcatttctctctcggctggccgttgtacttag

SEQ ID NO: 18045 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgaatgcggccaccacgccttcagcgactaccagtggcttgacgacaccgtcggtctcatcttccactccttcctcctcgtcccttacttctcctgcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18046 - DNA, 402 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgaccaccagtggctggacgacgccgtgggcctcgtcttccactccttcctcctcgtcccttacttctcaagccgtgggcctggcacagcaccggcaacagccgctggaccgtctcctacagccatcgacgccaccattccaacaccggatccctcgagagggatgaagtgttcgtccccaagaagaagtcagacatcaagtggtacggcaagtacctcaacaaccctttgcgacgcaccgtgatgttaacggttcagttcactctcggctggcctttgtacttag

SEQ ID NO: 18047 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccagtagtcatcgacgccaccattccaacactggctccctcgagagagacgaagtgtttgtccccaagaagaagtcagacatcaagtggtacggcaagtaccgcaacaaccctttgggacgcaccgtgatgttaacggttcagttcacgctcggctggcctttgtacttag

SEQ ID NO: 18048 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 18049 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 18050 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 18051 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaggtacctcaacatccctttgggacgcgccgtggttttaacggctcagttcacgctcggctggcctgagtacttag

SEQ ID NO: 18052 - DNA, 357 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18053 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18054 - DNA, 367 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtacacacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttggtacttag

SEQ ID NO: 18055 - DNA, 473 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctccacggcttgaccccggagcaggtggtggccatcgccagccacgatggcggcaagcaggcgctggggacggtccagcggctgttgccggtgctgtgccaggcccacggcttgaccccccagcaggtcatcgacgccaccattccaacactggctccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18056 - DNA, 370 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaagaaaaatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18057 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccacccgtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18058 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaaccctggctccctcgagagagacgaagtgtttgtccccaagaagaagtaagacatcaggtggtacggcaagtacctcaacaaccctgtgggacgcaccgtgatgttaacggttcagttccatctcggctggcctttgtacttag

SEQ ID NO: 18059 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctagtcatcgacgccaccattccaacactggctccctcgagagagacgaagtgtttgtccccaagaagaagtcagacatcaagtggtacggcaagtacctcaacaacccgttgagacgcaccgtgatgttaacggttcagttcactctcggctggcctttgtacttag

SEQ ID NO: 18060 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttccgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18061 - DNA, 425 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgactaccagtggcttgacgacaccgtcggtctcatcttccactccttccactccatgcatgcactgcctttttgcgtttctacaaactcttcctggctagcggtacgcgtattaattgcgttgcgctcactgcccgctttccagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 18062 - DNA, 357 bp, Artificial
  Mutation in BnaA.FAD2.a introduced by TALE nuclease pair BnFAD2_T02
cctctcctccctcaccctctcccttacctcgcctggcaactctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaccccgttgggacgcaccgtgatgttaacgtttcagttcactctcggctggcctgtgtacttag

SEQ ID NO: 18063 - DNA, 315 bp, Artificial
  Mutation in BnaA.FAD2.a introduced by TALE nuclease pair BnFAD2_T02
cctctcctccctcaccctctcccctacttcgcctggcctctctactgggcctgccagggctgcgtcctaaccggcgtctgggtcatagcccacgagtgcggccaccacgccttcagcgactaccagtggctggacgacaccgtcggcctcatcatcgacgccaccattccaacactggctccctcgagagagacgaagtgtttgtccccaagaagaaatccgacatcaagtggtacggaaagtacctcaacaacccgctagggcgcacggtgatgctaaccggccatttctcgctcggctggccgatgtacttag

SEQ ID NO: 18064 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtatacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 18065 - DNA, 361 bp, Artificial
  Mutation in BnaA.FAD2.a introduced by TALE nuclease pair BnFAD2_T02
ctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18066 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaaaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18067 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtcatgttaacggttcagttcactctcggctggcctttgtacttag

SEQ ID NO: 18068 - DNA, 394 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggacgccattgctggcgatggccaccacctgctggggggtcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18069 - DNA, 359 bp, Artificial
  Mutation in BnaA.FAD2.a introduced by TALE nuclease pair BnFAD2_T02
cctctcctccctcaccctctatcctacttcgcctggcatctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 18070 - DNA, 364 bp, Artificial
  Mutation in BnaA.FAD2.a introduced by TALE nuclease pair BnFAD2_T02
cctctcctccctcaccctctcccttacctcggctggcccctttactgggactgccaaggctgcgtcctaaagggactctgggtcatcgcccacgagtgcggccaccacgccttcagcgaccaccagtggctggacgacgccgtgggcctcgtcttccactccttcctcctcgtcccttacttctcctggaagttacacagtcatcgacgccaccattccaacactggctccctcgagagagacgaagtgtttgtccccaagaagaagtcagacatcaagtggtacggcaattagctcaaaaactcagtggggcgcaccgtgatgttaaccgttcagttcactctcggctggcctttgtacttag

SEQ ID NO: 18071 - DNA, 370 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaagtaagaaaaatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18072 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgtcctttgtacttag

SEQ ID NO: 18073 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggattcattgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18074 - DNA, 353 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18075 - DNA, 413 bp, Artificial
  Mutation in BnaA.FAD2.a introduced by TALE nuclease pair BnFAD2_T02
cctctcctccctcaccctctctcctacttcgcatggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacaatggccaccacctgctggggggtcaagccgtgggcctggcacagcaccggcagtcatcgacgccaccattccaacactggctccctcgagagagacgaagtgtttgtccccaagaagaagtcagacatcaagtggtacggcaagtacctcaacaaccctttgggacgcaccgtggtgttaacggttcagttcactctcggctggcctttgtacttag

SEQ ID NO: 18076 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 18077 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 18078 - DNA, 357 bp, Artificial
  Mutation in BnaA.FAD2.a introduced by TALE nuclease pair BnFAD2_T02
cctctcctccctcaccctctcccttacctcgcctcgcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18079 - DNA, 341 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18080 - DNA, 339 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccaccatttcaacactggcttcctcgagagagacgaagtgtttgtccccaagaagaagtcagacatcaagtgttacggcaagtacctcaacaaccctttgggacgcaccgtgatgttaacggttcagttcactctcggctggcctttgtacttag

SEQ ID NO: 18081 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagggatgaagtgttcgtccccaagaagaagtcagacatcaagtggtacggaaagtacctcaacaacccgctaggacgcacggtgatgctaaccgtccagttcacgctcggctggcctttgtacttag

SEQ ID NO: 18082 - DNA, 321 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacgccgtgggcctcgtcttccactccttcctcctcgtcccttacttctcctggaagagagagacgaagtgtttgtccccaagaagaagtcagacatcaagtggtacggcaagtacctcaacaaccctttgggacgcaccgggatgttaacggttcagttcactctcggctggcctgtgtacttag

SEQ ID NO: 18083 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18084 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctctgctggcctttgtacttag

SEQ ID NO: 18085 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaggtcaccgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18086 - DNA, 394 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtattgagtgagctgataccgctcgccgcagccgaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18087 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggtcatcgacgccaccattccaacactggctccctcgagagagacgaagtgtttgtccccaagaagaagtcagacatcaagtggtacggcaagtaccgcaacaaccctgtgggacgcaccgtgatgttaacggttcagttcactctcggctggcctttgtacttag

SEQ ID NO: 18088 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacacaccgtgatgttaacggttcagttcactctcggctggcctttgtacttag

SEQ ID NO: 18089 - DNA, 355 bp, Artificial
  Mutation in BnaA.FAD2.a introduced by TALE nuclease pair BnFAD2_T02
cctctcctccctcaccctctctcctacttcgcctcgcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18090 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcagccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18091 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttactaacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 18092 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 18093 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacatccctttgggacgcaccgtgatgttaacggttcagttcacgctcggctggcctttgtacttag

SEQ ID NO: 18094 - DNA, 435 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttggacacaggccaacttctcaagattgcaaaacgtggcggcgtgaccgcagtggaggcagtgcatgcatggcgtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18095 - DNA, 358 bp, Artificial
  Mutation in BnaA.FAD2.a introduced by TALE nuclease pair BnFAD2_T02
ctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccatacttctcctggaagcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 18096 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18097 - DNA, 294 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctccttgtcaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 18098 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggacatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 18099 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttccctctcggctggcctttgtacttag

SEQ ID NO: 18100 - DNA, 408 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcctcttccactccttcctcctcgtcccttacttctcctggaagtaccggtgctgtgccaggcccacggcttgaccccccagcaggtggtggccagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 18101 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtcttggtcatagcccacgagtgcggccaccacgccttcagcgactaccagtggctggacgacaccgtcggcctcatcttccactccttcctcctcgtcccttacttctagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18102 - DNA, 353 bp, Artificial
  Mutation in BnaA.FAD2.a introduced by TALE nuclease pair BnFAD2_T02
cctctcctccctcaccctctcccttacctcgcctggcccatctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgattttaacggttcagttcactctcggctggcctttgtactag

SEQ ID NO: 18103 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacaacaagtggtacggcaagtacctcaacaaccctttgggacgctccgtgatgttaacggttcagttcactctcggctggccgttgtactta

SEQ ID NO: 18104 - DNA, 310 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaaccctttgggacgcaccgtgatgttaacggttcatttcactctcggctggcctttgtacttag

SEQ ID NO: 18105 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtaccgcaacaaccctgtgggacgcacggtgatgctaaccgtccagttcacgctcggctggcctttgtacttag

SEQ ID NO: 18106 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacgggtcagttcactctcggctggcctttgtacttag

SEQ ID NO: 18107 - DNA, 354 bp, Artificial
  Mutation in BnaA.FAD2.a introduced by TALE nuclease pair BnFAD2_T02
cctctcctccctcaccctctctcctacttcgcatggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcatcgacgccaccattccaaccctggctccctcgagagagacgaagtgtttgtccccaagaagaagtcagacatcaagtggtacggcaattacctcaacaacccttcgggactcaccgtgatgttaacggttcagttcactctcgggttgcctttgtacttag

SEQ ID NO: 18108 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccttggggacgcaccgtgatgttaaccgttcagttcactctcggctggcctttgtacttag

SEQ ID NO: 18109 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 18110 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaacatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 18111 - DNA, 344 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggacaccattccaacactggctccctcgagagagacgaagtgtttgtccccaagaagaagtcagacatcaagtggtacggcaagtacctcaacaaccctgtgggacgcaccgtgatgttaacggttcagttcactctcggctggccgttgtacttag

SEQ ID NO: 18112 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtcggcctcatcttccactccttcctcctcgtcccttacttctcctggacatcgacgccaccattccaacactggctccctcgagagagacgaagtgtttgtccccaagaagaagtcagacatcaagtggtacggcaattacctcaacatccctttgggacgcaccgtgatgttaacggttcagttcactctcggctggcctttgtgcttag

SEQ ID NO: 18113 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcaaacatcaagtggtacggcaagtacctcaacaaccctttgggacgcaccgtgatgttaacggttcagttcacgctcgggttgcctttgtacttag

SEQ ID NO: 18114 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18115 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 18116 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcggacatcaagtggtacggcaagtacctcaacaaccctttgggacgcaccgtgatgttaacggttcagttcactctcggctggcctttgtacttag

SEQ ID NO: 18117 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacatgcctttgggacgcaccgtgatgttaacggttcagttcacgctcggctggcctttgtacttag

SEQ ID NO: 18118 - DNA, 346 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagccaccattccaacactggctccctcgatagagacgaagtgtttgtccccaagaagaaatccgacatcaagtggtacggcaagtacctcaacaaccctttgggacgcaccgtgatgttaacggttcagttcactctcggctggcctttgtacttag

SEQ ID NO: 18119 - DNA, 408 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtaccggtgctgtgccaggcccacggcttgaccccccagcaggtggtggccagtcatcgacgccaccattccaacactggctccctcgagagagacgaagtgtttgtccacaagaagaagtcagacatcaagtggtacggcaagtacctcaacaaccctttgggacgcaccgtgatgttaacggttcagttcactctcggctggcctttgtacttag

SEQ ID NO: 18120 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 18121 - DNA, 389 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggacagcaacgtcggttcgagatggcgctcgaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18122 - DNA, 356 bp, Artificial
  Mutation in BnaA.FAD2.a introduced by TALE nuclease pair BnFAD2_T02
cctctcctccctcaccctctcccttacctcgcctggacactctactgggcctgccaaggctgcgtcctaacgggcctctgggtcatcgcccacgaatgcggccaccacgccttcagcgaccaccagtggctggacgacgccgtgggcctcgtcttcaactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgggatgttaacggttcagttctctctcggttggccttggtacttag

SEQ ID NO: 18123 - DNA, 420 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgccgctgccaagttcgagagaccgcacctggacagcatcgatgcctcgggcatccaagcacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18124 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtactgcaagtacctcaacaaccctttgggacgcaccgtgatgttaacggttcagttcactctcggctggcctttgtacttag

SEQ ID NO: 18125 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggactcaccgtgatgttaacggttcagttcactctcggctggcctttgtacttag

SEQ ID NO: 18126 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 18127 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18128 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 18129 - DNA, 383 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagactgagcctttcgttttatttgatgcgtcatcgacgccaccattccaacactggctcactcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18130 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagctaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18131 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 18132 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18133 - DNA, 357 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 18134 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 18135 - DNA, 366 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacaatcagaaaaggtccactgggttcgtgccttccaccattccaacactggctccctcgagagagacgaagtgtttgtccccaagaagaagtcacacatcaagtggtacggcaattaccgcaacaacccgttgtggcgcaccgtgatgttaacgggtcagttcactctcggctggcctttgtacttag

SEQ ID NO: 18136 - DNA, 312 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcgtctttgtccccaagaagaagtcagacatcaagtggtacggcaagtacctcaacaaccctttgggacgcaccgtgatgttaacggttcagttcactctcggctggcccttggtacttag

SEQ ID NO: 18137 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccgacactggctccctcgagagagacgaagtgtttgtccccaagaagaagtcagacatcaagtggtacggcaagtacctcaacaaccctttgggacgcaccgtgatgttaacgcttcagttcactctcggctggcctttgtacttag

SEQ ID NO: 18138 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggacatagccctcgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18139 - DNA, 363 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18140 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctcatcgacgccaccattccaacacttgctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18141 - DNA, 329 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccacttacagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctgtcctttgtacttag

SEQ ID NO: 18142 - DNA, 315 bp, Artificial
  Mutation in BnaA.FAD2.a introduced by TALE nuclease pair BnFAD2_T02
cctctcctccctcaccctctctcctacttcgcctcgcctctctactgggcctgccagggctgcgtcctaaccggcgtctgggtcatagcccacgagtgcggccaccacgccttcagcgactaccagtggctggacgacaccgtcggcctcatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18143 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 18144 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgccccttacttctcctggaacaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 18145 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcatggaaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18146 - DNA, 355 bp, Artificial
  Mutation in BnaA.FAD2.a introduced by TALE nuclease pair BnFAD2_T02
cctctcctccctcaccctctctcctacttcgcctggactctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18147 - DNA, 473 bp, Artificial
  Mutation in BnaA.FAD2.a introduced by TALE nuclease pair BnFAD2_T02
cctctcctccctcaccctctcccttacctcgcctggcacccctactgggcctgccaaggctgcgtcctaacgggcctctgggtcatcgcccacgaatgcggccaccacgccttcagcgaccaccagtggctggacgacgccgtgggccccgtattccactccttcctcctcgtcccttacttctccacggcttgaccccggagcaggtggtggccatcgccagccacgatggcggcaagcaggcgctggagacggtccagcggctgttgccggtgctgtgccgggcccgcggcttgaccccccagcaggtcatcgacgccaccattccaacgctggctccctcgggagagacgaagtgttggtccccaagaagaagtcagacttcaagtggtacggcaagtaccgcaacaaccctttggcacgctccgtgattttagcggttcagttcactctcggctggcctttgtacttag

SEQ ID NO: 18148 - DNA, 360 bp, Artificial
  Mutation in BnaA.FAD2.a introduced by TALE nuclease pair BnFAD2_T02
cctctcctccctcaccctctatcctacttcgcctggcccctccactgggcctgccagggctgcgtcctaaccagcgtctgggtcctagcccaccagtgcggccaccacgcctccagcgactaccagtggcttgacgacaccgtcggtctcatcttccactccttccgcctcgtcccttacttctcctggaagtcagtcatcgacgccaccattccaacactggctccctcgagagagacgaagtgtgtgtccccaagaagaaggcaaacatcgagtggtacggcaaggacctcaacaaccctctgagacggaccgtgatgttaacggctcagttcgctctcgggtggcctaggtacttag

SEQ ID NO: 18149 - DNA, 344 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttcctcatcgacgccaccattccaacactggctccctcgagagagacgaagtgtttgtccccaagaagaaatccgacatcaagtggtgcggaaagtacctcaacaacccgctaggacgcacggtgatgctaaccgtccagttcacgctcggctggcctttgtacttag

SEQ ID NO: 18150 - DNA, 408 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcctcttccactccttcctcctcgtcccttacttctcctggaagttgagcggggcacccgtcagtgcattgcgccatgcatgcactgcctccaaagtcatcgacgccaccattccaacactggctccctcgagagagacgaagtgtttgtccccaagaagaagtcagacatcaagtggtacggcaagtacctcaacaaccctctgggccgcaccgtgatgttaacggttcagttcacgctcggctggcctttgtacttag

SEQ ID NO: 18151 - DNA, 312 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcgacgccaccattccaacactggctccctcgagagagacgaagtgtttgtccccaagaagaagtcagacatcaagtggtacggcaagtacctcaacaaccctgtgggacgcaccgtgatgttaacggttcagtgcactctcggcttgcctttgtacttag

SEQ ID NO: 18152 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactgctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18153 - DNA, 411 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtacgcgtaccgcgagccaggaagagtttgtagaaacgcaaaaaggccatccccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggccttagtacttag

SEQ ID NO: 18154 - DNA, 404 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtatctccagcgcctgcttgccaccgccattgctggcgatggccaccagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 18155 - DNA, 356 bp, Artificial
  Mutation in BnaA.FAD2.a introduced by TALE nuclease pair BnFAD2_T02
cctctcctccctcaccctctctcctacttcgcctggccactctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaaggacctcaacaacccgctaggacgcacggtgatgctaaccgtccatttcacgcgcggctagccagagtacttag

SEQ ID NO: 18156 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcttcttccactccttcctcctcgtcccttacttctcctggaagatcatcgacgccaccattccaacactggctccctcgagagagacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 18157 - DNA, 356 bp, Artificial
  Mutation in BnaA.FAD2.a introduced by TALE nuclease pair BnFAD2_T02
cctctcctccctaccctctccattacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18158 - DNA, 460 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagcgatggccaccacctgctggggggtcaagccgtgggcctggcacagcaccggcaacagccgctggaccgtccccagcgcctgcttgccaccgccattgctggcgatggtcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18159 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtatacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 18160 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggacatcgacgccaccattccaacactggctccctcgagagagacgaagtgtttgtccccaagaagaaatccgacatcaagtggtacggaaattaccgcaacaacccgctaggactcacggtgatgctaaccgtccagttctcgctcggctggcctttgtacttag

SEQ ID NO: 18161 - DNA, 357 bp, Artificial
  Mutation in BnaA.FAD2.a introduced by TALE nuclease pair BnFAD2_T02
cctctcctccatcaccctctcccttacctcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 18162 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaaggacctcaacaacccgctaggacgcacggtgatgctaaccttccagttcacgctcggctggcctttgtacttag

SEQ ID NO: 18163 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacgtttcagttcactctcggctggcctttgtacttag

SEQ ID NO: 18164 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgcagtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18165 - DNA, 343 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcctcttccactccttcctcctcgtcccttactatcgacgccaccattccaacactggctccctcgagagagacgaagtgtttgtccccaagaagaagtcacaactcaagtggtacggcaagcacctcagcatgcctccgggacgccccgtgatttttacccctcagttgacgcccggctgccctcagtacttag

SEQ ID NO: 18166 - DNA, 358 bp, Artificial
  Mutation in BnaA.FAD2.a introduced by TALE nuclease pair BnFAD2_T02
cctctcctccatcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 18167 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaaaactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18168 - DNA, 447 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagcaatgacattcttgcaggtatcttcgagccagccacgatcgacattgatctggctatcttgctgacaaaagcaagagaacatagcgttgcctcatcgacgccaccattccaacactggctccctcgagagagacgaagtgtttgtccccaagaagaagtcagacatcaagtggtacggcaagtacctcaacaaccctttgggacgcaccgtgatgttaacggttcatttcactctcggctggcctgtgtacttag

SEQ ID NO: 18169 - DNA, 355 bp, Artificial
  Mutation in BnaA.FAD2.a introduced by TALE nuclease pair BnFAD2_T02
cctctcctccctcaccctctcccctacttcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18170 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtacagtcatcgacgccaccattccaacactggctccctcgagagagacgaagtgtttgtccccaagaagaagtcagacatcaagtggtacggcaagtacctcaacaaccctgtgggacgcaccgtgaggttaaccgttcagttcactctcggctggcctttgtacttag

SEQ ID NO: 18171 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcgtcttccactccttcctcctcgtcccttacttctcctggaacacagccatcgacgccaccattccaacactggctccctcgagagagacgaagtgtttgtccccaagaagaagtcagacatcaagtggtacggcaagtacctcaacaaccctttggaacgcaccgtgatgttaacggttcagttcactctcggctggccagtgtacttag

SEQ ID NO: 18172 - DNA, 355 bp, Artificial
  Mutation in BnaA.FAD2.a introduced by TALE nuclease pair BnFAD2_T02
cctctcctccctcacccactctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtattag

SEQ ID NO: 18173 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgtgtcctaacgggcctctgggtcatcgcccacgaatgcggccaccacgccttcagcgaccaccagtggctggacgacaccttcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18174 - DNA, 359 bp, Artificial
  Mutation in BnaA.FAD2.a introduced by TALE nuclease pair BnFAD2_T02
cctctcctccctaaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18175 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccacaacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18176 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgcattcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18177 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccctttgtacttag

SEQ ID NO: 18178 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 18179 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcacacatcaagtggtacggcaagtacctcaacaaccctttgggacgcaccgtgatgttaacggttcagttcactctcggctgccctttgtacttag

SEQ ID NO: 18180 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtacccgagaagaagtcggacatcgagtggtacggaaaggacctcaacaacccgctaggacgcacggtgatgctaaccgtccagttcacgctcggctggcctttgtacttag

SEQ ID NO: 18181 - DNA, 346 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccgtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18182 - DNA, 293 bp, Artificial
  Mutation in BnaA.FAD2.a introduced by TALE nuclease pair BnFAD2_T02
cctctcctccctcacctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctccttgtcaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18183 - DNA, 352 bp, Artificial
  Mutation in BnaA.FAD2.a introduced by TALE nuclease pair BnFAD2_T02
cctctcctccctcaccctctctcctacttcgcctggccactctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcgacgccaccattccaacactggctccctcgagagagacgaagtgtttgtccccaagaagaagtcagacatcaagtggtccggcaggtacctcaacaaccctgtgggacgcaccgtgatgttaacggttcagttcactctcggctggcctttgtacttag

SEQ ID NO: 18184 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacataaagtggtacggcaagtacctcaacaaccctttgggacgcaccgtgatgttaacggttcagttcactctcggctggcctttgtacttag

SEQ ID NO: 18185 - DNA, 357 bp, Artificial
  Mutation in BnaA.FAD2.a introduced by TALE nuclease pair BnFAD2_T02
cctctcctccctcaccctctctcctacttcgcctggcctccctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacatctcctggaaagtcatcgacgccaccattccaacactggctccctcgagagagacgaagtgtttgcccccaagaagaagtcagacatcaagtggtacggcaagtacctcaacaacccgttggaacgctccgtgatgttaacggtttagttcactctcggctggccttggtacttag

SEQ ID NO: 18186 - DNA, 356 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaactcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18187 - DNA, 393 bp, Artificial
  Mutation in BnaA.FAD2.a introduced by TALE nuclease pair BnFAD2_T02
cctctctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacgccattgctggcgatggccaccacctgctggggggtcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttaactctcggctggcctttgtacttag

SEQ ID NO: 18188 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaaggcagacatcaagtggtacggcaagtacctcaacaaccctttgggacgcaccgtgatgttaacggttcagttcactctcggctggccttggtacttag

SEQ ID NO: 18189 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggctggacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18190 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcctcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaacccttagggacgcaccgtgatgttaacggttcagttcgctctcggctgtcctttgtacttag

SEQ ID NO: 18191 - DNA, 353 bp, Artificial
  Mutation in BnaA.FAD2.a introduced by TALE nuclease pair BnFAD2_T02
cctctcctccctcaccctctcacctacttcgcctggcatctctaatgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 18192 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctgaccggcgtctgggtcatagcccacgagtgcggccaccacgccttcagcgactaccagtggctggacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18193 - DNA, 358 bp, Artificial
  Mutation in BnaA.FAD2.a introduced by TALE nuclease pair BnFAD2_T02
cctctcctccctcaccctctatcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgcgcggctggcctttgtacttag

SEQ ID NO: 18194 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtacatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 18195 - DNA, 312 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 18196 - DNA, 353 bp, Artificial
  Mutation in BnaA.FAD2.a introduced by TALE nuclease pair BnFAD2_T02
cctctcctccctcaccctctctcctacttcgcctggcctctctcctgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaatcgacgccaccattccaacactggctccctcgagagagacgaagggtttgtccccaagaagaagtcagacatcaagtggtacggcaagtacctcagcaaccctttgggacgcaccgtgaggttaacggttcaggtcacgctcggctggcctttgtacttag

SEQ ID NO: 18197 - DNA, 422 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacggcttgaccccggagcaggtggtggccatcgccagccacgatggcggcaagcaggcgctggagtcatcgacgccaccattccaacactggctccctcgagagagacgaagtgtttgtccccaagaagaagtcagacatcaagtggtacggcaagtacctcaacaaccctttgggacgcaccgtgatgttaccggttcagttcactctcggctggcctttgtacttag

SEQ ID NO: 18198 - DNA, 349 bp, Artificial
  Mutation in BnaA.FAD2.a introduced by TALE nuclease pair BnFAD2_T02
cctctcctccctcaccctctctcctacttcgcctggcatatctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttccgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacttgcggccggcctgtatacttag

SEQ ID NO: 18199 - DNA, 373 bp, Artificial
  Mutation in BnaA.FAD2.a introduced by TALE nuclease pair BnFAD2_T02
cccctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgccaggcccaccaccagcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 18200 - DNA, 425 bp, Artificial
  Mutation in BnaA.FAD2.a introduced by TALE nuclease pair BnFAD2_T02
cctctcctccctcaccctctatcctacttcgcctggcctctctactgggcctgccagggctgcgtcctaaccggcgtctgggtcatagcccacgagtgcggccaccacgccttcagcgactaccagtggctggacgacaccgtcggcctcctcttccactccttcctcctcgtcccttacttctcctggaagtcccttaacgtgagttacgcgtcgttccactgagcgtcagaccccgtagaaaagatcaaaggatcttcagggtcgacgccaccattccaacactggctccctcgagagagactaagtgtttgtccccaagaagaagtcagacatcaagtggtacggcaagtacctcaacaacactttgggacgcaccgtgatgttaacggttcagttcactcgcggctggcctgtgtacttag

SEQ ID NO: 18201 - DNA, 357 bp, Artificial
  Mutation in BnaA.FAD2.a introduced by TALE nuclease pair BnFAD2_T02
cctctcctccctcaccctctcccttacctcgcctggcccctctcctgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 18202 - DNA, 341 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtccagtcatcgacgccaccattccaacactggctccctcgagagagacgaagtgtttgtccccaagaagaagtcagacatcaagtggtacggcaagtacctcaacaaccctttgggacgcaccgtgaggttaaccgtccagttcacgctcggctggccttggtacttag

SEQ ID NO: 18203 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaatggttcagttcactctcggctggcctttgtacttag

SEQ ID NO: 18204 - DNA, 428 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgaccaccagtggctggacgacgccgtgggcctcatcttccactccttcctcctcgtcccttacttctcctccagcgcctgcttgccaccattattgctggcgatggccaccacctgctggggggtcaagccgtgggcctggcacagcacctggacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18205 - DNA, 391 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtaggcgctaaatgaaaccttaacgctatggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18206 - DNA, 304 bp, Artificial
  Mutation in BnaA.FAD2.a introduced by TALE nuclease pair BnFAD2_T02
cctctcccctcaccctctctcctacttcgcctggcctctctactgggcctgccagggctgcgtcctaaccggcgtctgggtcatagcccacgagtgcggccaccacgccttcagcgactaccagtggctggacgacaccgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18207 - DNA, 312 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcgacgccaccattccaacactggctccctcgagagggatgaagtgtttgtccccaagaagaagtcagacatcaagtggtacggaaagtacctcaacaacccgctaggacgcacggtgatgctaaccgtccagttcacgcgcggctggcctttgtacttag

SEQ ID NO: 18208 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacaccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18209 - DNA, 356 bp, Artificial
  Mutation in BnaA.FAD2.a introduced by TALE nuclease pair BnFAD2_T02
cctctcctccctcaccctgtcccttacctcgcctggctcctctactgggcctgcccaggctgtgtcctaacggccctctgggtcatcgcccacgaatgcggccaccacgccttcagcgaccaccagtggctggacgacaccgtcggcctcatcttccactccttcctccccgtcccttacttctcctggaagtcatcgacgccacccttccaacactggctccctcgagagagacgaagtgtttgtccccaagaagaagtcagacatcaagtggaacggcaagtaccacaacaggcctgtggggcgcaccgggatggtaacggatcaattcactctcggctggcctgtttacttag

SEQ ID NO: 18210 - DNA, 312 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 18211 - DNA, 356 bp, Artificial
  Mutation in BnaA.FAD2.a introduced by TALE nuclease pair BnFAD2_T02
cctctcctccctcaccctctctcctacttcgcctggcaaccctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaaggacctcaacaacccgttgggacgccccgtgatgttaacgtttcagttcactctcgggtggcctgtgtacttag

SEQ ID NO: 18212 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttctcctggaagttatcagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18213 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcccatcgacgccaccattccaacactggatccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 18214 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 18215 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggccgttgtacttag

SEQ ID NO: 18216 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 18217 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcatcttccactccttcctcctcgtcccttacttctcctggaagtaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18218 - DNA, 363 bp, Artificial
  Mutation in BnaA.FAD2.a introduced by TALE nuclease pair BnFAD2_T02
cctctcctctctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtacacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 18219 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggccttggtacttag

SEQ ID NO: 18220 - DNA, 344 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgctgccaccacgccttcagcgactaccagtggcttgacgacaccgtcggtctcatcttccactccttcctcctcgtcccttacttctcctggacaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18221 - DNA, 348 bp, Artificial
  Mutation in BnaA.FAD2.a introduced by TALE nuclease pair BnFAD2_T02
cctctcctccctcaccctttcccttacctcgcctggcacctctcctgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttagtcatcgacgccaccattccaacactggctccctcgagagagacgaagtgtttgtccccgagaagaagtcagacatcaagtggtacggcaagtacctcaacaaccctttgggacgcaccgggatgttaacggttcagttcactctcggctggcctttgtacttag

SEQ ID NO: 18222 - DNA, 393 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtacatgttctttcctgcgttatcccctgattctgtggatatcgacgccaccattccaacaccggatccctcgagagggatgaagtgttcgtccccaagaagaagtcagacatcaagtggtacggcaagtacctcaacaaccctttgggacgcaccgtgatgttaactgttcagttcactctcggctggcctttgtacttag

SEQ ID NO: 18223 - DNA, 417 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtggagcggatttgtcctactcaggagagcgttcaccgacaaacaacagataaaacgaaaagtcatcgacgccaccattccaacactgactccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18224 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaaggcagacatcaagtggtacggcaagtacctcaacaaccctttgggacgcaccgtgatgttaacggttcagttcactctcggctggcctgtgtacttag

SEQ ID NO: 18225 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacagccctttgggacgcaccgtgatgttcacggttcagttcactctcggccggcctttgtacttag

SEQ ID NO: 18226 - DNA, 356 bp, Artificial
  Mutation in BnaA.FAD2.a introduced by TALE nuclease pair BnFAD2_T02
ctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 18227 - DNA, 329 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactaccagtcatcgacgccaccattccaacactggctccctcgagagagacgaagtgtttgtccccaagaagaagtcagacatcaagtggtacggcaagtacctcaacaaccctttgggacgcaccgtgatgttaacggttcatttcactctcggctggcctttgtacttag

SEQ ID NO: 18228 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 18229 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgcccttgtacttag

SEQ ID NO: 18230 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccatcagcgactaccagtggctggacgacaccgtcggcctcatcttccactccttcctcctcgtcccttacttctcctggaagtatcgacgccaccattccaacactggctccctcgagagagacgaagtgtttgtccccaagaagaagtcagacatcaagtggtacggcaagtacctcaacaaccctgtgggacgcgccgtgatgttaacggttcagttcactctcggcgggcctgtgtacttag

SEQ ID NO: 18231 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaataagaagtcagacatcaagtggtacggcaagtacctcaacaaccctttgggacgcaccgtgatgttaacggttcagttcactctcggctggcctttgtacttag

SEQ ID NO: 18232 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 18233 - DNA, 348 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgcgtgcggccaccacgacttcagcgactaccagtggctggacgacaccgtcggcctcatcttccactccttcctcctcgtcccttacttcttcatcgacgccaccattccaacactggctccctcgagagagactaagtgtttgtccccaagaagaagtcagacatcaagtggtacggcaagtacctcaacaaccctttggaacgcaccgtgatgttatcggttcagttcactctcgcctggcctttgtacttag

SEQ ID NO: 18234 - DNA, 346 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttccatcgacgccaccattccaacaccggatccctcgagagggatgaagtgttcgtccccaagaagaagtcagacatcaggtggtacggcaagtacctcaacaaccctttgggacgcaccgtgatgttaaccgtccagttcacgctcggctggcctttgtacttag

SEQ ID NO: 18235 - DNA, 306 bp, Artificial
  Mutation in BnaA.FAD2.a introduced by TALE nuclease pair BnFAD2_T02
cctctcctccctcaccctctctcctacttcgcctggcctctctactgggcctgccaggactgcgtcctaaccggcgtatgggtcatagcccacgagtgcggccaccacgccttcagcgactaccagtggctggacgacaccgtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 18236 - DNA, 331 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctccatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 18237 - DNA, 362 bp, Artificial
  Mutation in BnaA.FAD2.a introduced by TALE nuclease pair BnFAD2_T02
cctctcctccctcaccctctctcctacttcgcctggcctctctaatgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgcgcggctggcctttgtacttag

SEQ ID NO: 18238 - DNA, 422 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctcttggtcatcgcccacgaatgcggccaccacgccttcagcgaccaccagtggctggacgacaccgtcggcctcatcttccactccttcctcctcgtcccttacttctcctggaagtacggcttgaccccggagcaggtggtggccatcgccagccacgatggcggcaagcaggcgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18239 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtatcgacgccaccattccaacactggctccctcgagagagacgaagtgtttgtccccaagaagaagtcagacatcaagtggtacggcaagtacctcaacaacccgttgggacgcaccgtgatgttaacgtttcatttcactctcggctggcctgagtacttag

SEQ ID NO: 18240 - DNA, 357 bp, Artificial
  Mutation in BnaA.FAD2.a introduced by TALE nuclease pair BnFAD2_T02
cctctcctccctcaccctctctcctacttcgcctggcctctttactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 18241 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacaccggatccctcgagagggatgaagtgttcgtccccaagaagaaatccgacatcaagtggtacggaaagtacctcaacaacccgctaggacgcacggtgatgctaaccggccaggtcactctcgtctggcctttgtacttag

SEQ ID NO: 18242 - DNA, 335 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggcgatggccaccacctgctccggggtcaagccgtgggcctggcacagcaccggcaacagccgctggaaagtacctcaacaaccctttgggacgcaccgtgatgttaacggttcagttcactctcggctggcctttgtacttag

SEQ ID NO: 18243 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 18244 - DNA, 332 bp, Artificial
  Mutation in BnaA.FAD2.a introduced by TALE nuclease pair BnFAD2_T02
cctctcctccctcaccctctatcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaactggctccctcgagagagacgaagtgtttgtccccaagaagaagtcagacatcaagtggtacggcaagtacctcaacaaccctttgggacgcaccgtgatgtttacggttcagttcactctcggcgggcctttgtacttag

SEQ ID NO: 18245 - DNA, 341 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18246 - DNA, 306 bp, Artificial
  Mutation in BnaA.FAD2.a introduced by TALE nuclease pair BnFAD2_T02
cctctcctccctcaccctctctcctacttcgcctggcttctctactgggcctgccagggctgcgccctaaccggcgtctgggtcatagcccacgagtgcggccaccacgccttcagcgactaccagtggctggacgacaccgtcatcgacgccaccattccaacactggctccctcgcaagggatgaagtgttcgtccccaagaagaaatccgacatcaagtggtacggaaagtacctcaagaacccgctaggacgcacggggagtctaaacgaggaggtgacgttcggctgcccgttgtacttag

SEQ ID NO: 18247 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagccatcgacgccaccattccaacaccggatccctcgagagggatgaagtgttcgtccccaagaagaagtcagacatcaagtggtacggcaagtacctcaacaacccgctaggacgcacggtgatgctaaccgtccagttcacgctcggctggccgttgtacttag

SEQ ID NO: 18248 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaattacctcaacaaccctttgggacgcaccgtgatgttaaaggggaagttcactctcggccggaatgtgtacttag

SEQ ID NO: 18249 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcatcgactaccagtggctggacgacaccgtcggcctcctcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactatcggcaggcctttgtacttag

SEQ ID NO: 18250 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18251 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18252 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacacttgccccctcgagagagacgaagtgtttgtccccaagaagaagtcagacatcaagtggtacggaaagtacctcaacaacccgctaggacgcacggtgatgctaaccgtccagttcacgctcggctggcctgtgtacttag

SEQ ID NO: 18253 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccgacgtctgggtcatagcccacgagtgcggccaccacgccttcagcgactaccagtggcttgacgacaccgtcggacgcatcttccactccttcctcctcgtcccctacttctccatgatcatcgacgccaccattccaacaccggatccctcgagagggatgaagtgttcgtccccaagaagaaagccgacatcaagtggtacggaaaggacctcaacaaccctctagggcgcacggtgatgctaacccgccaattcacgccaggctggccgttggacttag

SEQ ID NO: 18254 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtgggcctcgtcttccactccttcctcctcgtcccttacttctcctgcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18255 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtcaccaagaagaagtcagacatcaagtggtacggcaagtacctcaacaaccctttgggacgcaccgtgatgttaacggttcagttcactctcggctggcctttgtacttag

SEQ ID NO: 18256 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctaggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaaaaagaagtcagacatcaagtggtacggcaagtacctcaacaaccctttgggacgcaccgtgatgttaacggttcagttcactcgcggctggcctttgtacttag

SEQ ID NO: 18257 - DNA, 336 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcgggcctttgtacttag

SEQ ID NO: 18258 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtatcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 18259 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctacctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18260 - DNA, 365 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtaactacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18261 - DNA, 318 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctccttgtcccttacttctcctggagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18262 - DNA, 366 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacaatcagaaaaggtccactgggttcgtgccttccaccattccaacactggctccctcgagagagacgaagtgtttgtccccaagaagaagtcagacatcaagtggtacggcaagtacctcaacaaccctttgggacgcaccttgatgttaacggttcagttcactctcggctggcctttgtacttag

SEQ ID NO: 18263 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcatttcactctcggctggccgttgtacttag

SEQ ID NO: 18264 - DNA, 335 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttactcaccattccaacactggctccctcgagagagacgaagtgtttgtccccaagaagaagtcagacatcaagtggtacggcaagtacctcaacaaccctttgggacgcaccgtgatgttaacggttcggttcactctcggctggcctttgtacttag

SEQ ID NO: 18265 - DNA, 340 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcagtcatcgacgccaccattccaacactggctccctcgagagagacgaagtgtttgtccccaagaagaagtcagatatcaagtggtacggcaattccctcaacacccctttgggacgcaacgtgatgttacccgttcagttccctctcggctggcctttgtacttag

SEQ ID NO: 18266 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggcccccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 18267 - DNA, 357 bp, Artificial
  Mutation in BnaA.FAD2.a introduced by TALE nuclease pair BnFAD2_T02
cctctcctccctcaccctctctcctacttcgcctggcctctctcctgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 18268 - DNA, 312 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcgacgccaccatttcaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 18269 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctacagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcacgctcggctggcctttgtacttag

SEQ ID NO: 18270 - DNA, 357 bp, Artificial
  Mutation in BnaA.FAD2.a introduced by TALE nuclease pair BnFAD2_T02
cctctcctccctcaccctctctcctacttcgcctggcatctctcctgggcctgccagggatgcgtcctaaccggcgtctgggtcatagcccacgagtgcggccaccacgccttcagcgactaccagtggcttaacgacaccgtcggcttcatcttccactccttcctcctcgtcccttacttctcctggaaagccatcgacgccaccattccaacactggctccctcgagagagacgaagtgtttgtccccaagaagaaatccgacatcaagtggtacggaaagtacctcaagaaccggctaggacgcacggtgaggctaaccgtccaggtcacgctcgcccggccttagtacttag

SEQ ID NO: 18271 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacggcaccgtcggcctcatcttccactccttcctcctcgtcccttacttctcctggaagtatacagtcatcgacgccaccagtccaacactggctccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 18272 - DNA, 409 bp, Artificial
  Mutation in BnaA.FAD2.a introduced by TALE nuclease pair BnFAD2_T02
cctctcctccctcaccctctctcctacttcgcctggtctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagcaacagccgctggaccgtctccagcgcctgcttgccgccatcgtggctggcgagtcatcgacgccaccattccaacaccggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18273 - DNA, 413 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacaatggccaccacctgctggggggtcaagccgtgggcctggcacagcaccggcagtcatcgacgccaccattccaacacgggctccctcgagagagacgaagtgtttgtccccaagaagaagtcagacatcaagtggtacggcaagtacctcaacaagccttggtgacgcaccgtgatgttaacggttcagttcacgctcggctggccgtggtacttag

SEQ ID NO: 18274 - DNA, 348 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttcttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18275 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacagccctttgggacgcacagtcatgttaacggttcatttcactctcggctggcctgtgtacttag

SEQ ID NO: 18276 - DNA, 367 bp, Artificial
  Mutation in BnaA.FAD2.a introduced by TALE nuclease pair BnFAD2_T02
cctctcctccctcaccctctcccctacttcgcctggcctctctactgggcctgccagggctgcgtcctcaccggcgtctgggtcatagcccacgagtgcggccaccacgccttcagcgactaccagtggctggacgacaccgtcggcctcatcttccactccttcctcctcgtcccttacttctcctggaagtacacacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcatttcactcgcggcgggcctttgtacttag

SEQ ID NO: 18277 - DNA, 342 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtccctgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18278 - DNA, 356 bp, Artificial
  Mutation in BnaA.FAD2.a introduced by TALE nuclease pair BnFAD2_T02
cctctcctccctcaccctctcacttacctcgcctggaccatctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18279 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctgtgtacttag

SEQ ID NO: 18280 - DNA, 346 bp, Artificial
  Mutation in BnaA.FAD2.a introduced by TALE nuclease pair BnFAD2_T02
cctctcctccctcaccctctctcctacttcgcctggcctccctactgggcctgccagggctgcgtcctaaccggcgtctgggtcatagcccacgagtgcggccaccacgccttcagcgaccaccagtggctggacgacaccgtcggcctcatcttccaatccttcctcctcgtcccttacttctcctggcgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18281 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaatcgacgccaccattccaacactggctccctcgagagggatgaagtgttcgtccccaagaagaaatccgacatcaagtggtacggaaagtacctcaacaaccctttggtacgcaccgtgatgttaacggttcagttcactctcggctggcctttgtacttag

SEQ ID NO: 18282 - DNA, 312 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 18283 - DNA, 363 bp, Artificial
  Mutation in BnaA.FAD2.a introduced by TALE nuclease pair BnFAD2_T02
cctctcctccctcaccctctctcctgcttctcctggcctctttactgtgcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaacccagttgtacacaccgtgatgttaacccttcagttaactctcggctggcctttgtacttag

SEQ ID NO: 18284 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18285 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcctagcccacgagtgcggccaccacgccttcagcgactaccagtggctggacgacaccgtcggcctcatcttccactccttcctcctcgtcccttacttctcctggaagtaacagtcatcgacgccaccattccaacaccggatccctcgagagagatgaagtgttcgtccccaagaagaaatccgacagcaagtggtacggaaagtaccgcaacagccctttgggacgcaccgtgatgttaacgtttcagttcactcgcggctggccttggtacttag

SEQ ID NO: 18286 - DNA, 341 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgagtgcggccaccacgccttcagcgactaccagtggctggacgacaccgtcggcctcatcttccactccttcctcctcgtcccttacttctcctggaaattccaacactggctccctcgagagagacgaagtgtttgtccccaagaagaagtcagacatcaagtggtacggcaagtaccgcaacaaccctttggtacgcaccgtgatgttaacggttcagttcactctcggctggcctttgtacttag

SEQ ID NO: 18287 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcggcgaccaccagtggctggacgacgccgtgggcctcgtcttccactccttcctcctcgtcccttacttctcctggaaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18288 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgtgtcatagcccacgagtgcggccaccacgccttcagcgactaccagtggctggacgacaccgtcggcctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18289 - DNA, 294 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctccttgtcaagtgtttgtccccaagaagaagtcagacatcaagtggtacggcaagtacctcaacaacccgctaggacgcacagtgatgctaaccgtccatttcacgctcggcggccctttgtacttag

SEQ ID NO: 18290 - DNA, 357 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18291 - DNA, 351 bp, Artificial
  Mutation in BnaA.FAD2.a introduced by TALE nuclease pair BnFAD2_T02
cctctcctccctcaccctctcacctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccttcatcgacgccaccattccaacactggctccctcgagagagacgaagtgtttgtccccaagaagaagtcagacatcaagtggtacggcaagtaccgcaacaaccctttgggacgcaccgtgatgttaacggttcagttcactctcggcaggcctttgtacttag

SEQ ID NO: 18292 - DNA, 467 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggcaacgtcggttcgagattgcgctcgatgacgccaactacctctgatagttatttatgagatgggtttttatgattagaggcccgcaattatacatttaatacgcgagagggcagcgacgccaccagtccaacaatggctccctcgagagagacgaagtggtggtccccaagaagaaatccgacatcaagtggtacggaaagtacctcaacaacccgctaggacgcacggtgatgctaaccgtccagttcacgctcggctggcctttgtacttag

SEQ ID NO: 18293 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgttatgttaacggttcagttcactctcggctggcctttgtacttag

SEQ ID NO: 18294 - DNA, 467 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtggaaagcgggcagtgagcgcaacgcaattaagctcgccgcgttgtttcatcaagccttacggtcaccgtaaccagcaaatcaatatcactgtgtggcttcaggccgccagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcatgcgcggctggcctttgtacttag

SEQ ID NO: 18295 - DNA, 339 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacgacgccaccattccaacactggctccctcgagagagacgaagtgtttgtccccaagaagaagtcagacatcaagtggtacggaaaggacctcaacaacccgctaggacgcacggtgaggctaaccttccagtgcacgctcggctggcctttgtacttag

SEQ ID NO: 18296 - DNA, 347 bp, Artificial
  Mutation in BnaA.FAD2.a introduced by TALE nuclease pair BnFAD2_T02
cctctcctccctcaccctctctcctacttcgcctggcttctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttatccatgacgccaccagtccaacaccggatccctcgatagagacgaagtgttcgtccccaagaagaaatccgacatcaagtggtacggaaagtacctcaacaacccgctaggacgcacggtgatgctaaccgtccagttcacgctcggcaggcctttgtacttag

SEQ ID NO: 18297 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtcggtctcatcttccactccttcctcctcgtcccttacttctcctggaagtacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18298 - DNA, 434 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtatggcggcaagcaggcgctggagacggtccagcggctgttgccggtgctgtgccaggcccacggcttgaccccccagtcatcgacgccaccattccaacactggctccctcgagagagacgaagtgtttgtccccaagaagaagtcagacgtcaagtggtacggcaagtacctcaacaaccctttgggacgcaccgtgatgttaacggttcagttcactctcgtctggcctttgtacttag

SEQ ID NO: 18299 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccgtttgggacgcaccgtgagtttaacggttaaggtgactctcggctggcctctgtacttag

SEQ ID NO: 18300 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcatcatcttccactccttcctcctcgtcccttacttctcctggaaagtcatcgacgccaccattccaacactggctccctcgagagagacgaagtgtttgtccccaagaggaaatccgacatcaagtggtacggaaagtacctcaacaacccgctaggacgcacggtgatgctaaccgtccagttcacgctcggctggcctttgtacttag

SEQ ID NO: 18301 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttctcctggaagtatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18302 - DNA, 362 bp, Artificial
  Mutation in BnaA.FAD2.a introduced by TALE nuclease pair BnFAD2_T02
cctctcctccctcaccctctctcctacttcgcctggcctctctcctgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18303 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttgtacttag

SEQ ID NO: 18304 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 18305 - DNA, 356 bp, Artificial
  Mutation in BnaA.FAD2.a introduced by TALE nuclease pair BnFAD2_T02
cctctcctccctcaccctctctcctacttcgcctggcctctctaatgggcctgccagggctgcgtcctaaccggcgtctgggtcatagcccacgagtgcggccaccacgccttcagcgactaccagtggctggacgacaccgtcggcctcatcttccactcctttctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgttatgttaacggttcatttcactctcgtccggcctttgtacttag

SEQ ID NO: 18306 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcataacgggcctctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18307 - DNA, 336 bp, Artificial
  Mutation in BnaA.FAD2.a introduced by TALE nuclease pair BnFAD2_T02
cctctcctccctcaccctctatcctacttcgcctggactgtttactgggcctgccaagggtgcgtccacaccggcgtctgggtcctagcccacgagtgcggccaccacgccttcagcgactaccagtggctggacaacaccgtcggcctcatcttccactccttcctcctcgtcatcgacgccaccattccaacactggctccctcgagagagacgaagtgtttgtccccaagaagaagtcagacatcaagtggtacggcaattacctcaacaacccttggggacgcaccgggaggttgacggttcagttcactctcggctggcctttgtacttag

SEQ ID NO: 18308 - DNA, 387 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtccctttgcctggcacagcaccggcaacagccgctggaccgtctccagctgtcatcgacgcaaccattccaacactggctccctcgagagggatgaagtgttcgtccccaagaagaaatccgacatcaagtggtacggaaagtacctcaacaacccgctaggacgcacggtgaggctaaccgtccagttcacgcgcggctggcctttgtacttag

SEQ ID NO: 18309 - DNA, 363 bp, Artificial
  Mutation in BnaA.FAD2.a introduced by TALE nuclease pair BnFAD2_T02
cctctcctccctcaccctctcccttacctcgcctggcccctctactgggcctcccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacacagtcagcgacgccaccattccaacactggctccctcgagagagacgacgtgtttgtccccaagaagaagtcagacatcaagtggtacggcaagtacctcaacacccctttgggtcccaccgtgatgttcacggttcagttcactctcggccggcatttgtacttag

SEQ ID NO: 18310 - DNA, 312 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 18311 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacatcgacgccaccattccaacactggttccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18312 - DNA, 443 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagcaggtggtggccatcgccagcaatggcggtggcaagcaggcgctggagacggtccagcggctgttgccggtgctgtgccaggcccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18313 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaacatcgacgccaccattccaacactggctccctcgagatagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18314 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaatcgacgccaccattccaacactggctccctcgagagagacgaagtgtttgtccccaagaagaagtcagacatcaagtggtacggcaagtacctcaacaaccctttgtgacgcaccgtgatgttaacggttcagttcactctcggctggcctttgtacttag

SEQ ID NO: 18315 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttaactctcggctggcctttgtacttag

SEQ ID NO: 18316 - DNA, 356 bp, Artificial
  Mutation in BnaA.FAD2.a introduced by TALE nuclease pair BnFAD2_T02
cctctcctccctcaccctctctcctacttcgcctggcctctctacttggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggacgtcatcgacgccaccattccaacactggctccctcgagagagacgaagtgtttgtccccaagaagaagtcagacatcaagtggtccggcaagtccctcaccacccctttgggacgcaccgtgatgttaacggtccagttcactctcggctggcctttgtacttag

SEQ ID NO: 18317 - DNA, 354 bp, Artificial
  Mutation in BnaA.FAD2.a introduced by TALE nuclease pair BnFAD2_T02
cctctcctccctcaccctctcccttacctcgcctggcccctctcctgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctgtgggacgcaccgtgaggttaacggttcagttcactctcggctggcctttgtacttag

SEQ ID NO: 18318 - DNA, 357 bp, Artificial
  Mutation in BnaA.FAD2.a introduced by TALE nuclease pair BnFAD2_T02
cctctcctccctcaccctctctcctacttcgcctggcctctctcctgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18319 - DNA, 357 bp, Artificial
  Mutation in BnaA.FAD2.a introduced by TALE nuclease pair BnFAD2_T02
cctctcctccctcaccctctatcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacatcgacgccaccattccaacactggctccctcgagagagacgaagtgtttgtccccaagaagaagtcagacatcaagtggtacggcaagtacctcaacaaccctttgggacgcaccttgatgttaacggttcagttcactctcggctggcctttgtacttag

SEQ ID NO: 18320 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcatcgacgccaccattccaacactggctccctcgagagagacgaagtgtttgtccccaagaagaagtcagacatcaagtggtactgcaagtacctcaacaacccttggggacgcaccgtgatgttaacggttcagttcactctcggctggcctttgtacttag

SEQ ID NO: 18321 - DNA, 394 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccgctcgccatgcatgcactgcctccactgcggtagtcatcgacgccaccattccaacactggctccctcgagagagacgaagtgtttgtccccaagaagaagtcagacatcaagtggtacggcaagtacctcaacaaccctttgggacgcaccgggaggttaacggttcagttcactctcggcgggcctttgtacttag

SEQ ID NO: 18322 - DNA, 356 bp, Artificial
  Mutation in BnaA.FAD2.a introduced by TALE nuclease pair BnFAD2_T02
cctctcctccctcaccctctctcctacttcgcctggcctatttactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggcttcctcgagagagacgaagtgtttgtccccaagaagaagtcagacatcaagtggtacggcaattaccacaacaaccctttgggacgcaccgtgatgttaacggttcagttcactctcggctggcctttgtacttag

SEQ ID NO: 18323 - DNA, 359 bp, Artificial
  Mutation in BnaA.FAD2.a introduced by TALE nuclease pair BnFAD2_T02
cctctcctccctcaccctctctcctacttcgcctggcctctctcctgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 18324 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtgacttgacgacaccgtcggtctcatcttccactccttcctcctcgtcccttacttctcctggaagtcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18325 - DNA, 357 bp, Artificial
  Mutation in BnaA.FAD2.a introduced by TALE nuclease pair BnFAD2_T02
cctctcctccctcaccctctcccctacttcgcctggcctctctcctgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagggtttgtccccaagaagaagtcagacatcaagtggtccggcaagtacctcaacaaccctttgggccgcaccggaatgttatcggtgcaggtcacgcgtgggtggcctgtgtacttag

SEQ ID NO: 18326 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagccacgagtgcggccaccacgccttcagcgactaccagtggctggacgacaccgtcggcctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18327 - DNA, 357 bp, Artificial
  Mutation in BnaA.FAD2.a introduced by TALE nuclease pair BnFAD2_T02
cctctcctccctcaccctctatcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaaccgccctttgggacgcaccgtgatgttaacggttcagttcactctcggctggcctttgtacttag

SEQ ID NO: 18328 - DNA, 336 bp, Artificial
  Mutation in BnaA.FAD2.a introduced by TALE nuclease pair BnFAD2_T02
cctctcctccctcaccctctcacttacctcgcctggcccctctcatgggcctgccaaggatgcgtcctaccgggcctctgggtcatcgcccacgaatgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtccggcaagtacctcaacaaccctttggtacgcaccgtgatgttaacggttcagttcactcgcggccggcctgtgtacttag

SEQ ID NO: 18329 - DNA, 363 bp, Artificial
  Mutation in BnaA.FAD2.a introduced by TALE nuclease pair BnFAD2_T02
cctctcctccctcaccctcttccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacagccctgtgggacgctccgtgatggtaacggttcagttctctctcggcgggcctttgtacttag

SEQ ID NO: 18330 - DNA, 358 bp, Artificial
  Mutation in BnaA.FAD2.a introduced by TALE nuclease pair BnFAD2_T02
cctctcctccctcaccctctcccttacctcgcctggcccctctcctgggcctgccaaggctgcgtcctaacgggcctctgggtcatcgcccacgagtgcggccaccacgccttcagcgaccaccagtggctggacgacgccgtgggcctcgtcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctgtgggacgcaccgggatgttaacggtgcatttcacttgcggctggcctgtgtacttag

SEQ ID NO: 18331 - DNA, 355 bp, Artificial
  Mutation in BnaA.FAD2.a introduced by TALE nuclease pair BnFAD2_T02
cctctcccctcaccctctccattacctcgcctggctcctctactgggcctgccaaggctgcgtcctaacgggcctctgggtcatcgcccacgaatgcggccaccacgccttcagcgaacaccagtggctggaccacgccgtgggcctcgtcttccactccttcctcctcgtcccttacttctcctggaaggtcatcgacgccgccattccaacactggctccctcgagagagacgaagtgtttgtccccaagaagaagtcagacctcaagtggtacggcgattacctcaacagcggtgtgggaggggccgtgatgttaacggttcaggtcactctcgtccggcctgtgtacttag

SEQ ID NO: 18332 - DNA, 423 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagttaggccaccacttcaagaactctgtagcaccgcctacatacctcgctctgctaatcctgttagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18333 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcgggccttggtacttag

SEQ ID NO: 18334 - DNA, 412 bp, Artificial
  Mutation in BnaA.FAD2.a introduced by TALE nuclease pair BnFAD2_T02
cctctcctccctcaccctctatcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctattattattccaccaggtggtggccatcgccagcaataatggtggcaagcaggcgctggagtcatcgacgccaccattccaacactggctccctcgagagagacgaagtgtttgtccccaagaagaagtcagacatcaagtggtacggcaagtacctcaacaaccctttgggacgcagcgtgatgttaacggtgcagttcactcgcggccggcctttgtacttag

SEQ ID NO: 18335 - DNA, 350 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 18336 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtgactggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18337 - DNA, 388 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtggcagttccctactctcgcgttcgaatacagccatcgacgccaccattccaacaccggatccctcgagagggatgaagtgttcgtccccaagaagaagtcagacatcaagtggtacggcaagtacctcaacaaccctgtgggacgcaccgtgatgttaacggttcagttcactctcggctggcctttgtacttag

SEQ ID NO: 18338 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttactcctcctcatcgacgccaccattccaacactggctccctcgagagagacgaagtgtttgtccccaagaagaagtcagacatcaagtggtacggcaagtacctcaacaaccctttgggacgcaccgtgatgttaacggtccagttcacgctcggctggcctttgtacttag

SEQ ID NO: 18339 - DNA, 400 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtctccaaattgcagttcgcgcttagctggataacgccacggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcgggcctttgtacttag

SEQ ID NO: 18340 - DNA, 360 bp, Artificial
  Mutation in BnaA.FAD2.a introduced by TALE nuclease pair BnFAD2_T02
cctctcctccctcaccctctcacctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtcagtcatcgacgccaccattccaacactggctccctcgagagagacgaagtgtttgtccccaagaagaagtcagacatcaagtggtacggcaagtacctcaacaaccttttgggacgcaccgtgatgttaacggttcagttcactcgcggctggcctttgtacttag

SEQ ID NO: 18341 - DNA, 448 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcctcttccactccttcctcctcgtcccttacttctcctggaagtactccagcgcctgcttgccgccatcgtggctggcgatggccaccacctgctccggggtcaagccgtgggcctggcacagcaccggcaacagtcatcgacgccaccattccaacactggctccctcgagagagacgaagtgtttgtccccaagaagaagtcagacatcaagtggtacggcaagtaccgcaacaaccctgtgggacgcaccgtgatgttaacggttcagttcactctcggctggcctttgtacttag

SEQ ID NO: 18342 - DNA, 358 bp, Artificial
  Mutation in BnaA.FAD2.a introduced by TALE nuclease pair BnFAD2_T02
cctctcctccctcaccctctctcctacttcgcctggactctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggcgggcctttgtacttag

SEQ ID NO: 18343 - DNA, 411 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacgcgtaccgctagccatgaagagttcgtagaaacgcaaaaaggccatccccagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 18344 - DNA, 422 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacggcttgaccccggagcaggtggtggccatcgccagccacgatggcggcaagcaggcgctggagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 18345 - DNA, 408 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagttgagcggggcacccgtcagtgcattgcgccatgcatgcactgcctccaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18346 - DNA, 358 bp, Artificial
  Mutation in BnaA.FAD2.a introduced by TALE nuclease pair BnFAD2_T02
cctctcctccctcaccctctaccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcgggcctttgtacttag

SEQ ID NO: 18347 - DNA, 341 bp, Artificial
  Mutation in BnaA.FAD2.a introduced by TALE nuclease pair BnFAD2_T02
cctctcctccctcaccctctctcctagttcgtgtggccactctactgggccagccagggctgcgtcctaaccggcggctgggtcatagcccacgagtgcggccaccacgccttcagcgactaccagtggcttgacgacaccgtcggtctcatcttccactccttcctcctcgtcccttacttctcctggaaattccaacactggctccctcgagagagacgaagtgtttgtccccaagaagaagtcagacatcaagtggtacggcaagtccctcaacacccctgtgggacgcaccgtgatgttaaccgttcagctccctctcggctggcctttgtacttag

SEQ ID NO: 18348 - DNA, 356 bp, Artificial
  Mutation in BnaA.FAD2.a introduced by TALE nuclease pair BnFAD2_T02
cctctcctccctcaccctctctcctacttcgcctggcatctctcctgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgctaggacgcacggtgatgctaaccttccagttcacgctcggctggcctttgtacttag

SEQ ID NO: 18349 - DNA, 346 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagccaccattcaaacactggctccctcgagagagacgaagtgtttgtccccaagaagaagtcagacatcaagtggttcggcaagtacctcaacaaccctttgggacgcaccgtgatgttaacggttcagttcactctcggctggcctgtgtacttag

SEQ ID NO: 18350 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaagtaaggcacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18351 - DNA, 356 bp, Artificial
  Mutation in BnaA.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaattacctcaacaaccctttgggacgcaccgtgatgtttacggttcagttcactctcgtctgtcctttgtacttag

SEQ ID NO: 18352 - DNA, 387 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggcgatggccaccacctgctccggggtcacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18353 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 18354 - DNA, 446 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtactttgcaagcagcagattacgcgcagaaaaaaaggatctccgctcccggcggatttgtcctactcaggagagcgttcaccgacaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18355 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18356 - DNA, 346 bp, Artificial
  Mutation in BnaA.FAD2.a introduced by TALE nuclease pair BnFAD2_T02
cctctcctccctcaccctctcccttacctcgcctggccccactactgggcctgccaaggctgcgtcctaaccggcctctgggtcatcgcccacgaatgcggccaccacgccttcagcgaccaccagtggctggacgacgccgtgggcctcgtcttccactccttcctcctcgtcccttacttctccaggagcaggcaatccaacactggctccctcgagagagacgaagtgtttgtccccaagaagaagtcagacatcaagtggtacggcaaatacctcaacaaccctgtgggacgcaccgggaggttatcggtgcaggtgactctcggccgccctttgtacttgg

SEQ ID NO: 18357 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgaatgcggccaccacgccttcagcgactaccagtggcttgacgacaccgtcggtctcatcttccactccttcctcctcgtcccttacttctcctggcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 18358 - DNA, 416 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacacaggccaacttctcaagattgcaaaacgtggcggcgtgaccgcagtggaggtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18359 - DNA, 389 bp, Artificial
  Mutation in BnaA.FAD2.a introduced by TALE nuclease pair BnFAD2_T02
cctctcctccctcaccctctaccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactcctccctcctcgtcccttacttctcctggaagtacagcaacgtcggttcgagatggcgctcgaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18360 - DNA, 363 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtgactggacgacaccgtcggcctcgtcttccactccttcctcctcgtcccttacttctcctggaagttggttgtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 18361 - DNA, 355 bp, Artificial
  Mutation in BnaA.FAD2.a introduced by TALE nuclease pair BnFAD2_T02
cctctcctccctcaccctctctcctacttcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgccccgtgatgttaacggttcagttcactcccggctggcctttgtacttag

SEQ ID NO: 18362 - DNA, 340 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcttccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18363 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctgtgtacttag

SEQ ID NO: 18364 - DNA, 354 bp, Artificial
  Mutation in BnaA.FAD2.a introduced by TALE nuclease pair BnFAD2_T02
cctctcctccctcaccctctaccttacctcgcctggcccctctactgggcctgccagggctgcgtcctaaccggcgtctgggtcatagcccacgagtgcggccaccacgccttcagcgactaccagtggctggacgacaccatcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18365 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgctaggacgcacggtgatgctaaccggccagttcacgctcgtctggcctttgtacttag

SEQ ID NO: 18366 - DNA, 356 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgaggttaacgtttcatttcactcgcgcctggcctgagtacttag

SEQ ID NO: 18367 - DNA, 453 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtcggtctcatcttccactccttcctcctcgtcccttacttctcctggaaagcgcaacggctgttgccggagctgtgccaggcccacggcttgaccccccagcaggtggtggccatcgccagcaatggcggtggcaagcaggcgctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18368 - DNA, 363 bp, Artificial
  Mutation in BnaA.FAD2.a introduced by TALE nuclease pair BnFAD2_T02
cctctcctccctcaccctctatcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatacagccatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 18369 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18370 - DNA, 291 bp, Artificial
  Mutation in BnaA.FAD2.a introduced by TALE nuclease pair BnFAD2_T02
cctctcctccctcaccctctcgcttacctcgcctggcccctctactgggcctgccaaggctgcgtcctaacgggcctctgggtcatcgcccacgaatgcggccaccacgccttcagcgactaccagtggctggacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18371 - DNA, 357 bp, Artificial
  Mutation in BnaA.FAD2.a introduced by TALE nuclease pair BnFAD2_T02
cctctcctccctcaccctctctcctacttcgcctggcatctctactgggcctgccagggctgcgtcctaaccggcgtctgggtcatagcccacgagtgcggccaccaagccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaagtcagacagcaagtggtacggcaagtacctcaacaacccttgtggacgcaccgtgaggttaacggttcagttcactcccggctggcctttgtacttag

SEQ ID NO: 18372 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcgggcctttgtacttag

SEQ ID NO: 18373 - DNA, 416 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacacaggccaacttctcaagattgcaaaacgtggcggcgtgaccgcagtggaggtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 18374 - DNA, 393 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacaacactggctccctcgagagagacgaagtgtttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 18375 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaactcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 18376 - DNA, 362 bp, Artificial
  Mutation in BnaA.FAD2.a introduced by TALE nuclease pair BnFAD2_T02
cctctcctccctcaccctctatcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18377 - DNA, 356 bp, Artificial
  Mutation in BnaA.FAD2.a introduced by TALE nuclease pair BnFAD2_T02
cctctcctccctcaccctctctcctacttcgcctggcatctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtacatcgacgccaccattccaacactggctccctcgagagagacgaagtgtttgtcccaagaagaagtcagacatcaagtggtacggcaagtacctcaacaaccctttgggacgcaccgtgaggttaacggttcagttcactctcggcgggcctttgtacttag

SEQ ID NO: 18378 - DNA, 357 bp, Artificial
  Mutation in BnaA.FAD2.a introduced by TALE nuclease pair BnFAD2_T02
cctctcctccctcaccctctctcctacttcgcctggcatctctcatgggcctgccagggctgcgtcctaaccggcgtctgggtcatagcccacgagtgcgaccaccacgccttcagcgactaccagtggctggacgacaccgtcggcctcatcttccactccttcctcctcgtcccttacttctcctggaaagtcatcgacgccaccattccaacactggctcactcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 18379 - DNA, 351 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctgcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18380 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgatgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18381 - DNA, 389 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacagcaacgtcggttcgagatggcgctcgaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18382 - DNA, 357 bp, Artificial
  Mutation in BnaA.FAD2.a introduced by TALE nuclease pair BnFAD2_T02
cctctcctccctcaccctctcccctacttcgcctggcctctctaatgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaaagccgacatcaagtggtacggaaagtaccgcaacaaccctttggggcgcaccgtgatgttatcggttcagttcactcgtgtgcgtcctgtgtacttag

SEQ ID NO: 18383 - DNA, 343 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttgccatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 18384 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtaagtcatcgacgccaccattccaacactggctccctcgagagagacgaagtgtttgtccccaagaagaagtcagacatcaagtggtacggcaagtacctcaacaacccttagggacgcgccgtgatgttaacggttcagttcactctcggctggccttggtacttag

SEQ ID NO: 18385 - DNA, 358 bp, Artificial
  Mutation in BnaA.FAD2.a introduced by TALE nuclease pair BnFAD2_T02
cctctcctccctcaccctcgctcctacttcgcctggcctctctaatgggcctgccagggctgcgtcctacccggcgtctgggtaatagcccacgagtgcggccaccacgccttcagcgactaccagtggctggacgacaccgtcggcctcatcttccactccttcctcctcgtcccttacttctcctggaaaagtcatcgacgccaccattccaacactggctccctcgagagagacgaagtgtttgtccccaagaagaagacagacatcaagtggtacggcaagtacctcaacaaccgttgggatcgcgccgtgatgttaacgtttcagttcactcgcggctggcctgcgtacttag

SEQ ID NO: 18386 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagttgtacggcaagtacctcaacaaccctttgggacgcaccgtgatgttaacggttcagttcactctcggctggcctttgtacttag

SEQ ID NO: 18387 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctcaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaaatccgacatcaagtggtacggaaagttcctcagcaacccactaggacgcgcggtggggcttaccgcccagttcacgcgcggcgggccttagtacttag

SEQ ID NO: 18388 - DNA, 357 bp, Artificial
  Mutation in BnaA.FAD2.a introduced by TALE nuclease pair BnFAD2_T02
cctctcctccctcaccctctctcctacttcgcctggcctctctcctgggcctgccagggctgcgtcctaacaggcgtctgggtcatagcccacgagtgcggccaccacgccttcagcgactaccagtggctggacgacaccgtcggcctcatcttccactccttcctcctcgtcccttacttctcctggagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18389 - DNA, 362 bp, Artificial
  Mutation in BnaA.FAD2.a introduced by TALE nuclease pair BnFAD2_T02
cctctcctccctcaccctctctcctacttcgcctggcccctctacttggcctgccaaggctgcgtcctaacgggcctctgtgtcatcgcccacgaatgcggccaccacgccttcagcgaccaccagtggctggacgacgccgtgggcctcgtcttccactccttcctcctcgtcccttacttctcctggaagtacaagtcatcgacgccaccattccaacactggctccctcgagagagacgaagtgtttgtccccaagaagaagtcacacatcaagtggtacggcaagtaccccaacaaccgtttgggccgcaccgtgaggctaacggttcagttccctcccggccggcctttgtacttag

SEQ ID NO: 18390 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggcatcgacgccaccattccaacactggctccctcgagagagacgaagtgtttgtccccaagaagaagtcagacatcaagtggtacggcaagtacctcaacacccctgtgggacgcaccgtgatgttaacggatcagttcactctcggctggcctttgtccttag

SEQ ID NO: 18391 - DNA, 357 bp, Artificial
  Mutation in BnaA.FAD2.a introduced by TALE nuclease pair BnFAD2_T02
cctctcctccctcaccctctcccttacctcgcctggcacctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18392 - DNA, 357 bp, Artificial
  Mutation in BnaA.FAD2.a introduced by TALE nuclease pair BnFAD2_T02
cctctcctccctcaccctctctcctacttcgcctggcctccctcctgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacagcaagtggtacggcaagtacctcaacaaccctttgggacgcaccgtgatgttaacggttcagttcactctcggctggcctttgtacttag

SEQ ID NO: 18393 - DNA, 294 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctccttgtcaagtgtttgtccccaagaagaagtcagacatcaagtggtacggcaagtacctcaacaaccctttgggacgcaccgtgaggttaacggttcagtgcactcgcggctggcctttgtacgtag

SEQ ID NO: 18394 - DNA, 354 bp, Artificial
  Mutation in BnaA.FAD2.a introduced by TALE nuclease pair BnFAD2_T02
cctctcctccctcaccctctctcctatttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18395 - DNA, 395 bp, Artificial
  Mutation in BnaA.FAD2.a introduced by TALE nuclease pair BnFAD2_T02
cctctcctccctcaccctctcccttacctcgcctggaccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaagccgccggagtaggccttggtgtccacgatcacgccgtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18396 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcatcgacgccactattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 18397 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 18398 - DNA, 347 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 18399 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctagtcatcgacgccaccattccaacactggctccctcgagagagacgaagtgtttgtccccaagaagaagtcagacatcaagtggtacggcaattacctcaacaaccctttgggacgcaccgtgatgttaacggttcagttcactctcggctggcctttgtacttag

SEQ ID NO: 18400 - DNA, 358 bp, Artificial
  Mutation in BnaA.FAD2.a introduced by TALE nuclease pair BnFAD2_T02
cctctcctccctcaccctctatcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcacacatcaagtggtacggcaagtacctcaacaaccctttgggacgcaccgtgaggttaacggttcagttcactcgcggccggcatttgtacttag

SEQ ID NO: 18401 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccatcggcctcatcttccactccttcctcctcgtcccttacttctcctggaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 18402 - DNA, 358 bp, Artificial
  Mutation in BnaA.FAD2.a introduced by TALE nuclease pair BnFAD2_T02
cctctcctccctcaccctctctcctacttcgcctggcctccctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttggaacgcaccgtgatgttaacggtgcagttcactcgcggctggcctgtgtacttag

SEQ ID NO: 18403 - DNA, 353 bp, Artificial
  Mutation in BnaA.FAD2.a introduced by TALE nuclease pair BnFAD2_T02
cctctcctccctcaccctctctcctacttcgcctggcctctctcctgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18404 - DNA, 359 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtccctgacttctcctggaagtagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18405 - DNA, 357 bp, Artificial
  Mutation in BnaA.FAD2.a introduced by TALE nuclease pair BnFAD2_T02
cctctcctccctcaccctctcccttacctcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactgag

SEQ ID NO: 18406 - DNA, 379 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttccactccttacttactcgtcccctacaacctgcccatcggccaggccgacgccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 18407 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttactaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18408 - DNA, 346 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 18409 - DNA, 378 bp, Artificial
  Mutation in BnaA.FAD2.a introduced by TALE nuclease pair BnFAD2_T02
cctctcctccctcaccctctgccttacctcgcctggcccctctaatgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatatggcggcaagcaggcgatggagtcatcgacgccaccattccaacactggctccctcgagagagacgaagtgtttgtccccaagaagaagtcagacatcaagtggttcggcaagtacctcaacaaccctttgggacgcaccgtgaggttaacggttcagttcactcgcgggcggcctgtgtacttag

SEQ ID NO: 18410 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacagtcatcgacgccaccattccaacactggctccctcgagagagacgaagtgtttgtccccaagaagaagtcagacatcaagtggtacggctagtacctcaacaaccctttgggacgcaccgtgatgttaacggttcagttcactctcggctggcctttgtacttag

SEQ ID NO: 18411 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgctaaccgtccagttcacgctcggctggcctttgtacttag

SEQ ID NO: 18412 - DNA, 356 bp, Artificial
  Mutation in BnaA.FAD2.a introduced by TALE nuclease pair BnFAD2_T02
cctctcctccctcaccctctcgcttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18413 - DNA, 358 bp, Artificial
  Mutation in BnaA.FAD2.a introduced by TALE nuclease pair BnFAD2_T02
cctctcctccctcaccctctctcctacttcgcctggcatctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctgtgtacttag

SEQ ID NO: 18414 - DNA, 362 bp, Artificial
  Mutation in BnaA.FAD2.a introduced by TALE nuclease pair BnFAD2_T02
cctctcctccctcaccctctcccctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccgggaagttacagtcatcgacgccaccattccaacactggctccctcgagagagacgaagtgtttgtccccaagaagaagtcagacatcaagtggtacggcaagtaccgcaacaaccctgtgggacgcaccgtgatgttaacggttcagttcactctcggctggcctttgtacttag

SEQ ID NO: 18415 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgaggccgtgggcctcgtcttccactccttcctcctcgtcccttacttctcctgttcatcgacgccaccattccaaaactggctccctcgagagagacgaagtgtttgtccccaagaagaagtcagacatcaagtggtacggcaagtacctcaacaaccctttggaacgcaccgtgatgttaacggttcagttcactcccgggcggcctttgtacttag

SEQ ID NO: 18416 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 18417 - DNA, 336 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctgtgggacgcaccgtgaggttaacggttcagttcactctcggcgggcctttgtacttag

SEQ ID NO: 18418 - DNA, 422 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtacggcttgaccccggagcaggtggtggccatcgccagccacgatggcggcaagcaggcgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcgggcctttgtacttag

SEQ ID NO: 18419 - DNA, 357 bp, Artificial
  Mutation in BnaA.FAD2.a introduced by TALE nuclease pair BnFAD2_T02
cctctcctccctcaccctctcacttacctcgcctggcccctctcctgggcctgccaaggctgcgtcctaacgggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcgagtacctcaacaaccctttgggacgcaccgtgatgttaacggttcagttcactcgcggctggcctttgtacttag

SEQ ID NO: 18420 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagggatgaagtgttcgtccccaagaagaaatccgacatcaagtggtacggaaagtacctcaacaacccgctaggacgcacggtgatgctaaccagccagttcacgctcggctggcctgtgtacttag

SEQ ID NO: 18421 - DNA, 352 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 18422 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaattacctcaacaaccctttgggacgcaccgtgatgttaacggttcagttcactctcggctggcctttgtacttag

SEQ ID NO: 18423 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctccttgtcatcgacgccaccattccaacactggctccctcgagagagacgaagtgttcgtccccaagaagaaatcagacatcaagtggtacggcaagtacctcaacaaccctttgggacgcaccgtgatgttaacggttcagttcactctcggctggcctttgtacttag

SEQ ID NO: 18424 - DNA, 346 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccactaatgcggccaccacgccttcagcgaccaccagtggctggacgacgccgtgggcctcgtcttccactccttcctcctcgtcccttacttctcctggcgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18425 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcctcttccactccttcctcctcgtcccttacttctcctggaaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18426 - DNA, 335 bp, Artificial
  Mutation in BnaA.FAD2.a introduced by TALE nuclease pair BnFAD2_T02
cctctcctccctcaccctctcggctggcctctctactgggactgcaagggctgcgtcctaaccggcgtctgggtcatagcccacgagtgcggccaccacgccttcagcgactaccagtggctggacgacaccgtcggcctcatcttccactccttcctcctcgtcccttcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18427 - DNA, 310 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 18428 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcctcttccactccttcctcctcgtcccttacttctactggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactcag

SEQ ID NO: 18429 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactttcggctggcctttgtacttag

SEQ ID NO: 18430 - DNA, 387 bp, Artificial
  Mutation in BnaA.FAD2.a introduced by TALE nuclease pair BnFAD2_T02
cctctcctccctcaccctctcacctacttcgcctggcctatctactgggcctgccagggctgcgtcctcaccggcgtctgggtcatagcccacgagtgcggccaccacgccttcagcgactaccagtggcttgacgacaccgtcggtctcatcttccactccttcctcctcgtcccttacttctcctgggcctggcacagcaccggcaacagccgctggacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggcgggcctttgtacttag

SEQ ID NO: 18431 - DNA, 355 bp, Artificial
  Mutation in BnaA.FAD2.a introduced by TALE nuclease pair BnFAD2_T02
cctctcctccctcaccctctgtcctacttcgcctggcctctctactgggcctgccagggctgcgtcctaaccggcgtctgggtcatagcccacgagtgcggccaccacgccttcagcgactaccagtggctggacgacaccgtcggcttcatcttccactccttcctcctcgtcccttacttctcctggaatcatcgacgccaccattccaacactggctccctcgagagagacgaagtgtttgtccccaagaagaagtcaaacatcgagtggtacggaaaggacctcaacaacccgctaggtcgcacggtgatgctaaccgtgcaggtcacgtgcggctggcctgagtacttag

SEQ ID NO: 18432 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcgggcctttgtacttag

SEQ ID NO: 18433 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctgatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 18434 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggaagagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactcgcggctggcctttgtacttag

SEQ ID NO: 18435 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 18436 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctactcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18437 - DNA, 312 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctgtgtacttag

SEQ ID NO: 18438 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 18439 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18440 - DNA, 348 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18441 - DNA, 357 bp, Artificial
  Mutation in BnaA.FAD2.a introduced by TALE nuclease pair BnFAD2_T02
cctctcctccctcaccctctatcctacttcgcctggcatatctcctgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcgagtacctcaacaaccctttgggtcgcaccgtgatgttaacggttcatttcactcgcgggtggcctttgtacttag

SEQ ID NO: 18442 - DNA, 351 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcgacgccaccattccaatactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18443 - DNA, 318 bp, Artificial
  Mutation in BnaA.FAD2.a introduced by TALE nuclease pair BnFAD2_T02
cctctcctccctcaccctctatcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18444 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctacccggcgtctgggtcatagcccacgagtgcggccaccacgccttccgcgactaccagtggctggacgacaccgtcggcctcatcttccactccttcctcctcgtcccttacttctcctggaaggtcatcgacgccaccattccaacactggctccctcgagagagacgaagtgtttgtccccaagaagaaaaccgacatctagtggtacggaaactacctcaacaacccgttagtacgcacggttatgctaaccgaccagttctcgcgcggcgggcctttgtacttag

SEQ ID NO: 18445 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgaccaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 18446 - DNA, 395 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagccgccggagtaggccttggtgtccacgatcacgccgtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggccggcctgtgtacttag

SEQ ID NO: 18447 - DNA, 387 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggccccccagcaggtggtggccatcgccagcaatagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18448 - DNA, 358 bp, Artificial
  Mutation in BnaA.FAD2.a introduced by TALE nuclease pair BnFAD2_T02
cctctcctccctcaccctctaccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcgtctggcctttgtacttag

SEQ ID NO: 18449 - DNA, 443 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactcctccctcctcgtcccttacttctcctggaagtgcaatgcactgacgggtgccccgctcaacttgacccctctccagcgcctgcttgccgccatcgtggctggcgatggccaccaccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18450 - DNA, 355 bp, Artificial
  Mutation in BnaA.FAD2.a introduced by TALE nuclease pair BnFAD2_T02
cctctcctccctcaccctctcacctacttcgcctggcctccctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 18451 - DNA, 466 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcgggcaccacgccttcagcgaccaccagtggctggacgacgccgtgggcctcgtcttccactccttcctcctcgtcccttacttctcctggaagtacagcgacggtccctaacgctgccgggtgttggcttaaggcttgatgaaacaacgcggcgaggcccacggcttgaccccggagcaggtggtggccatcgccagccacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18452 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttgtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 18453 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtcggcctcatcttccactccttcctcctcgtcccttacttctagtcatcgacgccaccattccaacactggctccctcgagagagacgaagtgtttgtccccaagaagaagtcagacatcaagtggtacggcaagtacctcaacaacccttggggacgcaccgtgatgttaacgggtcagttcactcgcggctgtcctttgtacttag

SEQ ID NO: 18454 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggcgggcctttgtacttag

SEQ ID NO: 18455 - DNA, 401 bp, Artificial
  Mutation in BnaA.FAD2.a introduced by TALE nuclease pair BnFAD2_T02
cctctcctccctcaccctctcccttacctcgcctggcccctctaatgggcctgccaaggctgcgtcctaacgggcatctgggtcatcgcccacgaatgcggccaccacgccttcagcgactaccagtggctggacgacaccgtcggcctcatcttccactccttcctcctcgtcccttacttctcctggaaggcgctggagacggtccagcggctgttgccggtgctgtgccaatagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18456 - DNA, 417 bp, Artificial
  Mutation in BnaA.FAD2.a introduced by TALE nuclease pair BnFAD2_T02
cctctcctccctcaccctctctcctacttcgcctggactctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggatttgtcctactcaggagagcgttcaccgacaaacaacagataaaacgaaaggccgtcagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 18457 - DNA, 357 bp, Artificial
  Mutation in BnaA.FAD2.a introduced by TALE nuclease pair BnFAD2_T02
cctctcctccctcaccctctatcctacttcgcctggcctctctactgggcctgccagggctgcgtcctaaccggcgtctgggtcatagcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccgtttgggacgcgccgtgaggttaacggttcagttcactcgcggctggcctgtgtacttag

SEQ ID NO: 18458 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgcgcggctggcctttgtacttag

SEQ ID NO: 18459 - DNA, 353 bp, Artificial
  Mutation in BnaA.FAD2.a introduced by TALE nuclease pair BnFAD2_T02
ccctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18460 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagttgctggacgacaccgtcggcctcatcttccactccttcctcctcgtcccttacttctccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18461 - DNA, 356 bp, Artificial
  Mutation in BnaA.FAD2.a introduced by TALE nuclease pair BnFAD2_T02
cctctcctccctcaccctctcccttacctcgcctggcatcactaatgggcctgccagggctgcgtcctaaccggcgtctgggtcatagcccacgagtgcggccaccacgccttcagcgactaccagtggctcgacgacaccgtcggcctcatcttccactccttcctcctcctcccttacttctcctggaattcatcgacgccaccattccaacactggctccctcgagagagacgaagtgtttgtccccaagaagaagtcagacatcaagtggtacggcaatttcctcagcaacccttgtggacgcaccttgatgtttacgggtcatttctctctcgtccggcctctgtacttag

SEQ ID NO: 18462 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaataagtcagacatcaagtggtacggcaagtacctcaacagccctttgggacgcaccgtgatgttaacggtacagttcactcacggcgggcctttgtacttag

SEQ ID NO: 18463 - DNA, 365 bp, Artificial
  Mutation in BnaA.FAD2.a introduced by TALE nuclease pair BnFAD2_T02
cctctcctccctcaccctctctcctacttcgcctggcctctctcctgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaagtaactacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18464 - DNA, 450 bp, Artificial
  Mutation in BnaA.FAD2.a introduced by TALE nuclease pair BnFAD2_T02
cctctcctccctcaccctctctcctacttcgcctggcctatctcatgggcctgccagggatgcgtcctaaccggcgtctgggtcatagcccacgagtgcggccaccacgccttcagcgactaccagtggctggacgacaccgtcggcctcatcttccactccttcctcctcgtcccttacttctcctggatgactagcaggtaagggcgagatccggtgcagattatttggattgagagtgaatatgagactctaattggatgccgaggggaatttatggaacgtatcatcgacgccaccattccaacactggctccctcgagagagacgaagtgtttgtccccaagaagaagtcagacatcaagtggtacggcaagtacctcaacaaccctttggaacgcaccgtgatgttaacggttcagttcactctcggctggcctttgtacttag

SEQ ID NO: 18465 - DNA, 356 bp, Artificial
  Mutation in BnaA.FAD2.a introduced by TALE nuclease pair BnFAD2_T02
cctctcctccctcaccctctaccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18466 - DNA, 359 bp, Artificial
  Mutation in BnaA.FAD2.a introduced by TALE nuclease pair BnFAD2_T02
cctctcctccctcaccctcaatcctacttcgcctggcgtatatacagggcctgccaagggtgcgtcctaaccggcgtctgggtcatagcccacgaatgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcgagtacctcaacaaccctgtgggacgcaccgtgaggttaacggttcagttcactttcggcgggcctttgtacttag

SEQ ID NO: 18467 - DNA, 362 bp, Artificial
  Mutation in BnaA.FAD2.a introduced by TALE nuclease pair BnFAD2_T02
cctctcctccctcaccctctctcttacctcgcctggctcctctactgggcctgccaaggctgcgtcctaacgggcctttgggtcatcgcccacgaatgcggccaccacgccttcagcgaccaccagtggctggacgacgccgtgggcctcgtcttccactccttcctcctcgtcccttacttctcctggaaagtacagtcatcgacgccaccattccaacactggctccctcgagagagacgaagtgtttgtccccaagaagaagtcagacatcgagtggtacggcaagtacctcaacaaccctttgggacggaccgtgaggttaacggttcagttcactcacggctggcctttgtgcttag

SEQ ID NO: 18468 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18469 - DNA, 355 bp, Artificial
  Mutation in BnaC.FAD2.a introduced by TALE nuclease pair BnFAD2_T02
ccttcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18470 - DNA, 303 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgtctaccagtggcttgacgacgccagcgacgccaccattccaacactggctccctcgagagagacgaagtgtttgtccccaagaagaagtcagacataaagtggtacggcaagtacctcaacaaccctttgggacgcacagtgatgttaacggttcagttcactctcggctggcatttgtacttag

SEQ ID NO: 18471 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaattcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 18472 - DNA, 355 bp, Artificial
  Mutation in BnaC.FAD2.a introduced by TALE nuclease pair BnFAD2_T02
cctctcctccctcaccctctctcctacttcgcctggcctctctactgtgcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18473 - DNA, 387 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgggcctggcacagcaccggcaacagccgctggacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18474 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18475 - DNA, 341 bp, Artificial
  Mutation in BnaC.FAD2.a introduced by TALE nuclease pair BnFAD2_T02
cctctcctccctcaccctctctcctacttctcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18476 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctgccctttgtacttag

SEQ ID NO: 18477 - DNA, 357 bp, Artificial
  Mutation in BnaC.FAD2.a introduced by TALE nuclease pair BnFAD2_T02
cctctcctcactcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 18478 - DNA, 415 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacatctcaactctcccgccaccgtgagcaaggcctccagagcgcgtgcgccggaccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18479 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcgttctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgctccgtgatgttaacggttcagttcactctcggctggcctttgtacttag

SEQ ID NO: 18480 - DNA, 332 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18481 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcaacgactaccagtggcttgacgacaccgtcggtctcatcttccactccttcccccacgtcccttacttctcctggaacagtcatcgacgcctccattccaacactggctccctcgagagagatgaagtgttcgtacccaagaaggaaaccaacatcgagtggtacggaaagtccctcaacaacccgctagaacgcccggtgatgctaaccgtccagttcacgctcggctggcctttgtacttag

SEQ ID NO: 18482 - DNA, 354 bp, Artificial
  Mutation in BnaC.FAD2.a introduced by TALE nuclease pair BnFAD2_T02
ctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18483 - DNA, 358 bp, Artificial
  Mutation in BnaC.FAD2.a introduced by TALE nuclease pair BnFAD2_T02
cctctccttcctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18484 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18485 - DNA, 417 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaattgttgccggtgctgtgccaggcccacggcttgaccccggagcaggtggtggccatcgccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18486 - DNA, 348 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 18487 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccatcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 18488 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18489 - DNA, 344 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggacaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18490 - DNA, 336 bp, Artificial
  Mutation in BnaC.FAD2.a introduced by TALE nuclease pair BnFAD2_T02
catctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18491 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18492 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgccctttgtacttag

SEQ ID NO: 18493 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggacgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18494 - DNA, 420 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtactggaccgtctccagcgcctgcttgaaagataccaggcgtttccccctggaagctccctcagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 18495 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcacgctcggctggcctttgtacttag

SEQ ID NO: 18496 - DNA, 351 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18497 - DNA, 417 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtccacgatcacgccgtagtcgatgggggagcccaatcctgttgccggtcttgcgatgattatcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 18498 - DNA, 349 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttaatcgtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18499 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18500 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccaccattccaacactggctccctcgagagagacgaagtgtttgtccccaagaagaaatccgacatcaagtggtacggaaagtacctcaacaacccgctaggacgcacggtgatgctaaccgtccagttcactctcggctggcctttgtacttag

SEQ ID NO: 18501 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcgcctggcctttgtacttag

SEQ ID NO: 18502 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccgccattccaacactggctccctcgagagagacgaagtgtttgtacccaagaagaagtcagacatcaagtggtacggcaagtacctcaacaaccctttgggacgcaccgtgatgttaacggttcagttcactcgcggctggcctttgtacttag

SEQ ID NO: 18503 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactgactccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18504 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 18505 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtccctcaacaacccgctaggacgcacggtgatgctacccgtccagttcacgctcggttggcctttgtacttag

SEQ ID NO: 18506 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 18507 - DNA, 312 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttaacgacaccgtcggtctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18508 - DNA, 403 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagcaagatcgcttggcctcgcgcgcagatcagttggaagaatttgtccgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 18509 - DNA, 355 bp, Artificial
  Mutation in BnaC.FAD2.a introduced by TALE nuclease pair BnFAD2_T02
cctctcctccctcaccctctctcctacttcgcctggcctctctgctgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18510 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaatggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18511 - DNA, 355 bp, Artificial
  Mutation in BnaC.FAD2.a introduced by TALE nuclease pair BnFAD2_T02
cctctcctccctcaccctctctcctacttcgcctggcctctctcctgggcctgccaagggtgcgtcctaaccggcgtctgggtcatagcccacgagtgcggccaccacgccttccgcgactaccagtggcttgacgacaccgtccgcctcatcttccactccttcctcctcgtcccttacttctccagtagtcatcgacgccaccattccaacactggctccctcgagagagacgaagtgtttgtccccaagaagaagtcagacatcaactgctacgccaagtacctcaacaaccctttgggacgcgccgtgatgttaacggctcagttcgctctcgcctagcctttgcacctag

SEQ ID NO: 18512 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18513 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaaatccgacatcaagtggtacggcaagtacctcaacaaccctttgggacgcaccgtgatgttaacggttcagttcactctcggctggcctttgtacttag

SEQ ID NO: 18514 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18515 - DNA, 318 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18516 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaacccttggggacgcgccgtgatgttaacggttcagttcgctctcggctggcctttgtacttag

SEQ ID NO: 18517 - DNA, 356 bp, Artificial
  Mutation in BnaC.FAD2.a introduced by TALE nuclease pair BnFAD2_T02
cctctcctccctcaccctctcccttacctcggctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18518 - DNA, 336 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18519 - DNA, 345 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18520 - DNA, 359 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18521 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaacccgctgggacgcaccgtgatgttaacggttcagttcacgctcggctggcctttgtacttag

SEQ ID NO: 18522 - DNA, 356 bp, Artificial
  Mutation in BnaC.FAD2.a introduced by TALE nuclease pair BnFAD2_T02
cctctcctccctcaccatctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18523 - DNA, 344 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18524 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacgtcatcgacgccaccattccaacactggctccctcgagagagacgaagtgtttgtccccaagaagaagttagacatcaagtggtacggcaagtacctcaacaaccctttgggacgcaccgtgatgttaacggttcagttcactctcggctggcatttgtacttag

SEQ ID NO: 18525 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18526 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18527 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18528 - DNA, 345 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18529 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacaacggcgagctttgatcaacgaccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18530 - DNA, 364 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagttacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18531 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18532 - DNA, 385 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctcgtcttccactccttcctcctcgtcccaatacagccatcgacgccaccattccaacaccggatccctcgagagggatgaagtgttcgtacccaagaagaaaaccgacatcgagtggtacggaaagtacctcaacaaccctttgggacgcaccgtgatgttaacggttcagttcactcgcggctggcctttgtacttag

SEQ ID NO: 18533 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgaccacaccgtcggtctcatcttccactccttcctcctcgtcccttacttctcctggaaagtcatcgacgccaccattccaacactggctccctcgagagagacgaagtgtttgtccccacgaagaagtcagccatcaagtggtacggccagtacctcaacaaccctttgggacgcaccgtgatgttaacggttcagttcactctcggctggcctttgtacctag

SEQ ID NO: 18534 - DNA, 349 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18535 - DNA, 329 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccacttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18536 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18537 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcagcaaccccttgggacgcaccgtgatgttaacggttcagttcactctcggctggcctttgtacttag

SEQ ID NO: 18538 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18539 - DNA, 331 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18540 - DNA, 312 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18541 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 18542 - DNA, 318 bp, Artificial
  Mutation in BnaC.FAD2.a introduced by TALE nuclease pair BnFAD2_T02
catctcctccctcaccctctcccttacctcgcctggcctctctaaagggggggaaaagggtgcgtagaaaccggcgtctggggcatggcccacgagggcggccaccacgccttcagcgaccaccagtggctttacgacaaagtcggtagcatcttccactccttcctcctcgtcccttacttctcctggaagtagacgaagtgtttctccccaagaagaagtcagacatcaagtggtacggcaagtacctcaacaaccctttgggacgaaccgtgatgttaacggttcagttcactctcggctggcatttgtacttag

SEQ ID NO: 18543 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18544 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 18545 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18546 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18547 - DNA, 318 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagtagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18548 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18549 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 18550 - DNA, 355 bp, Artificial
  Mutation in BnaC.FAD2.a introduced by TALE nuclease pair BnFAD2_T02
cctatcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcagtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18551 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 18552 - DNA, 358 bp, Artificial
  Mutation in BnaC.FAD2.a introduced by TALE nuclease pair BnFAD2_T02
cctctcctccctcaacctctctcctacttcgcctggcctctctactgggcctgccaagggtgcgtcctaaccggcgtctgggtcatagcccacgagtgcggccaccacgccttcagcgactaccagtggctggacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18553 - DNA, 335 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactcaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18554 - DNA, 340 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcccaccattccaacaccggatccctcgatagggacgaagtgttcgtccccaagaagaaatccgacatcaagtgttacgtcaagtacctcaacaacccgctaggccgcacggtgatgctaaccgtccagttcacgctcggctggcctttgtacttag

SEQ ID NO: 18555 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcacagtgatgttaacgtttcagttcactctcgcctggcctttgcacttag

SEQ ID NO: 18556 - DNA, 396 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccccacggcttgaccccccagcaggtggtggccatcgccattctccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18557 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18558 - DNA, 336 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 18559 - DNA, 344 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactcatcgacgccaccattccaacactggctccctcgagagagacgaagtgtttgtccccaagaagaaatccgacatcaagtggtacggcaagtacctcaacaaccctttgggacgcaccgtgatgttaacggttcagttcactctcggctggcctttgtacttag

SEQ ID NO: 18560 - DNA, 356 bp, Artificial
  Mutation in BnaC.FAD2.a introduced by TALE nuclease pair BnFAD2_T02
cctctcctccatcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18561 - DNA, 352 bp, Artificial
  Mutation in BnaC.FAD2.a introduced by TALE nuclease pair BnFAD2_T02
ctctcctccctcaccctctctcctacttcgcctggcctctctactgggcctgccaagggtgcgtcctaaccggcgtctgggtcatagcccacgagtgcggccaccacgcctcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18562 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcctcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18563 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18564 - DNA, 355 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacggtcctctgggtcatcgcccacgaatgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18565 - DNA, 350 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18566 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggcttgacgacaccgtcggtctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18567 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcgaccaccacgccttcagcgactaccagtggcttgacgacaccgtcggtctcatcttccactccttcctcctcgtcccttacttctcctggaaagtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 18568 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18569 - DNA, 312 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18570 - DNA, 357 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18571 - DNA, 367 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacacacacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 18572 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 18573 - DNA, 303 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18574 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 18575 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18576 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18577 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccgtcagcgactaccagtggcttcacgacaccgtcggtctcatcttccactccttcctcctcgtcccttacttctcctggggtcatcgacgccaccattccaacactagcacactcgagaggaacgaagtgtttgtccccaagaagatgtcagccgtcaagtggtacggcaaataccgcaacaaccctttggggcgcaccgtgatgttcacggttcagtactctctcggctcgcctttgtacctag

SEQ ID NO: 18578 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18579 - DNA, 347 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18580 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18581 - DNA, 350 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18582 - DNA, 345 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacattccaacactggctccctcgagagagacgaagtgtttgtccccaagaagaagtcagacatcaagtggtacggcaagtacctcaacacccctttgggacgcaccgtgatgttaacggttcagttcactctcggctggcctttgtacttag

SEQ ID NO: 18583 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18584 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacaccggatccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 18585 - DNA, 312 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtccttag

SEQ ID NO: 18586 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccataaaacaaagttaaacattgggcttcctggagccgcccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18587 - DNA, 363 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcttaaccggcgtctgggtcatagcccacgagtgcggccaccacgccttcagcgactaccagtggcttgacgacaccgtcggtctcatcttccactccttcctcctcgtcccttacttctcctggaagtatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18588 - DNA, 407 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgtcgacaccgtcggtctcatcttccactccttcctcctcgtcccttacttctcctggaagtacggtgctgttccgggcgatctcgatcagctcgatgtactcgtgggacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18589 - DNA, 291 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18590 - DNA, 356 bp, Artificial
  Mutation in BnaC.FAD2.a introduced by TALE nuclease pair BnFAD2_T02
cctctcctccctcaccctatctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18591 - DNA, 343 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatcgcccacgaatgcggccaccacgccttcagcgaccaccagtggcttgacgacaccgtcggtctcatcttccactccttcctcctcgtcccttactatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18592 - DNA, 357 bp, Artificial
  Mutation in BnaC.FAD2.a introduced by TALE nuclease pair BnFAD2_T02
cctctcctcctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 18593 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 18594 - DNA, 348 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacgccgtgggcctcgtcttccactccttcctcctcgtcccttacttctcctggaacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18595 - DNA, 323 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaccgctcgccgcagccgaacgaccgagaagaagtcagacatcaagtggtacggcaagtacctcaacaaccctttgggacgcaccgtgatgttaacggttcagttcactctcggctggcctttgtacttag

SEQ ID NO: 18596 - DNA, 330 bp, Artificial
  Mutation in BnaC.FAD2.a introduced by TALE nuclease pair BnFAD2_T02
cctctctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18597 - DNA, 309 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtattag

SEQ ID NO: 18598 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcgggctcatcttccactccttcctcctcgtcccttacttctcctggaaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 18599 - DNA, 355 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18600 - DNA, 356 bp, Artificial
  Mutation in BnaC.FAD2.a introduced by TALE nuclease pair BnFAD2_T02
cctctcctccctcaccctctctcctacttcgcctggcctctctactgggcttgccaagggcgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtgcggcaagtagctcaacaaccctgtgggacgcacggtgatgttaacggttcagttcactctcggctggcctttgtacttag

SEQ ID NO: 18601 - DNA, 310 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctggatcatcgcccacgaatgcggccaccacgccttcagcgaccaccagtggcttgacgacaccgtcggtctcatcttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18602 - DNA, 349 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18603 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 18604 - DNA, 344 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggacaccattccaacactggctccctcgagagagacgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 18605 - DNA, 291 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccatcagcgactaccagtggcttgacgacaccgtcggaagactggctccctcgagagagacgaactgtttgtccccaagaagaaggcagacatcaagtggtacgacaagtacctcaacaaccctttgggacgcaccgtgatgttaacggttcagttcactctcggctgccatttgtacgtag

SEQ ID NO: 18606 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18607 - DNA, 346 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 18608 - DNA, 405 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaatgacggatggccttctgcttagtttgatgcctggcagtttatggcgggcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18609 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18610 - DNA, 354 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18611 - DNA, 357 bp, Artificial
  Mutation in BnaC.FAD2.a introduced by TALE nuclease pair BnFAD2_T02
cctctcatccctcaccctctcccttacctcgcctggcccctctactgggcctgccaagggtgcgtcctaaccggcgtctgggtcatagcccacgagtgcggccaccacgccttcagcgaccaccagtggcttgacgacaccgtcggtctcatcttccactccttcctcctcgtcccttacttctcctggaatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18612 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaacccttagggacgcaccgggatgttaacggttcagttcgctctcggctggcctttgtacttag

SEQ ID NO: 18613 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18614 - DNA, 365 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacaaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18615 - DNA, 347 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtactgag

SEQ ID NO: 18616 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacgccgtgggcctcgtcttccactccttcctcctcgtcccttacttctcctggaagtaagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 18617 - DNA, 359 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtactgag

SEQ ID NO: 18618 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcagtcatcgacgccaccattccaacactggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 18619 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagagtcatcgacgccaccattccaacactggctccctcgagagggatgaagtgttcgtccccaagaagaaatccgacatcaagtggtacggaaagtacctcaacaacccgctagggcgcacggtgatgctaaccgtccagttcacgctcggctggcctttgtacttag

SEQ ID NO: 18620 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggtcatcgacgccaccattccaacactggctccctcgagagagacgaagtgtttgtccccaagaagaagtcacacatcaagtggtacggcaagtacctcaacatccctttgggactcaccgtgatgttaacggttcagttcactctcggctggcctttgtacttag

SEQ ID NO: 18621 - DNA, 347 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccacgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18622 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggccttggtacttag

SEQ ID NO: 18623 - DNA, 310 bp, Artificial
  Mutation in BnaC.FAD2.a introduced by TALE nuclease pair BnFAD2_T02
cctctcctccctcaccctctcccttacctcgcatggcccctctactgggcctgccaaggctgcggcctaacgggcctctgggtcatcgcccacgaatgcggccaccacgccttcagcgaccaccagtggcttgacgacaccgtcggtctcatcttccaccattccaacactggctccctcgagagagacgaagtgtttgtccccaagaagaagtcagacatcaagtggtacggcaagtacctcaacaaccctttgggacgcaccgtggtgttaacggttcagttcactctcggctggcctttgtacttag

SEQ ID NO: 18624 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18625 - DNA, 364 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaagtattacagtcatcgacgccaccattccaacactggctccctcgagagagacgaagtgtttgtccccaagaagaagtcagacatcaagtggtacggcaagtacctcaacaaccctttgggacgcaccgtgatgctaaccgtccagttcacgctcggctggcctttgtacttag

SEQ ID NO: 18626 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18627 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18628 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18629 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18630 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 18631 - DNA, 342 bp, Artificial
  Mutation in BnaC.FAD2.a introduced by TALE nuclease pair BnFAD2_T02
cctctcctccctcaccctctctcctacttcgcctgccctctctactgtgcctcccacgggtgcgtcctcaccggcgtctggttcatagccacgcttgcggccaccacgccttcagcgactaccagtggcttgacgacaccgtcggtctcatcttccactccttcctcctcgtcccttactatcgacgccaccattccaacactggctccctcgagagagacgaagtgtttgtccccaagaagaagtcagacatcaagtggtacggaaagtacctcaacacgccagtggtatgtaccgggatgttaacggttccgctccctctcggctggcctttgtacttag

SEQ ID NO: 18632 - DNA, 318 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggcccccacgccttcagcgactaccagtggcttgacgacaccgtcggtctcctcttccactccttcctcctcgtcccttacttctcctggaagtagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18633 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcgggctcatcttccactccttcctcctcgtcccttacttctcctggaggtatcatcgacgccaccattccaacactggctccctcgagagagacgaagtgtttgtccccaacaagaagtcagacatcaagtggtacgacaagtacctcaccaaccctttgggacgcaccgtgatgttcacggttcagttcactctcggctggcctttatacttag

SEQ ID NO: 18634 - DNA, 318 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcatggaagtagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18635 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactcgcggctggcctgtgtacttag

SEQ ID NO: 18636 - DNA, 349 bp, Artificial
  Mutation in BnaC.FAD2.a introduced by TALE nuclease pair BnFAD2_T02
cctctcctccctcaccctctctcctacttcgcctggcctctctactgggcctgccaagggcgcgtcctaaccggcgtctgggtcatagcccacgagtgcggccaccacgccttcagcgactaccagtggcttgacgacaccgtcggtctcatcttccactccttcctcctcgtcccttacttctcctatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18637 - DNA, 354 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaagatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18638 - DNA, 291 bp, Artificial
  Mutation in BnaC.FAD2.a introduced by TALE nuclease pair BnFAD2_T02
cctctcctccctcaccctctctcctacttcgcctggcctctctactgggcctgccaatggtgcgtcctaaccggcgtctgggtcatagcccacgagtgcggccaccacgccttcagcgactaccagtggcttgacgacaccgtcggaagactggctccctcgagagagacgaactgtttgtccccaagaagaagtcagacatcaagtggtacggcaagtacctcaacaaccctttgggacgcaccgtgatgttaacggttcagttcactctcggctggcctttgtacttag

SEQ ID NO: 18639 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 18640 - DNA, 343 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18641 - DNA, 412 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggcttgacgacaccgtcggtctcatcttccactccttcctcctcgtcccttacttctcctggaagtcggtggacctctcccctctcccgcacccgtgagcaaggccgccagagcgcgtgcgtcatcgacgccaccattccaacactggctccctcgagagagaagaagtgtttgtccccaagaagaagtcagacatcaagtggtacggcaagtacctcaacaacccgttgggacgcaccgtgatgttaacggttcagttcactctcggctggcctttgtacttag

SEQ ID NO: 18642 - DNA, 357 bp, Artificial
  Mutation in BnaC.FAD2.a introduced by TALE nuclease pair BnFAD2_T02
cctctcctccctcaccctctctcctacttcgcctggattcttttctgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaattacctcaacaaccctgtggggcgcatcgtggggttaacggctccggtcactctcggctgccctttgtacttag

SEQ ID NO: 18643 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtactgcaagtacctcaacaaccctttgggacgcaccgtgatgttaacggttcagttcactctcggctggcctttgtacttag

SEQ ID NO: 18644 - DNA, 360 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaagtcagtcatcgacgccaccattccaacactggctccctcgagagagacgaagtgtttgtccccaagaagaagtcagacatcaagtggtacggcaagtacctcaacaaccctttgggacgcaccgtgatgctaaccgtccagttcacgctcggctggcctttgtacttag

SEQ ID NO: 18645 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18646 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcgtccaccacgccttcagcgactaccagtggctttacgacaccgtcggtctcatcttccactccttcctcctcgtcccttacttctcctggagtacagtcatcgacgccaccattccaacactggctccctcgacagagacgcagtgtttgtccccaagacgatgtcagacaccacctggtacgtcaagtacctcaccatcccttctggccgtgccgtgttgttaaaggctcagttcactctcggctggcctttgtccgcag

SEQ ID NO: 18647 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttggaacgcaccgtgatgttaacggttcagttcactctcggctggcctttgtacttag

SEQ ID NO: 18648 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttcagcgacgccaccattccaacactggctccctcgagagagacgaagtgtttgtccccaagaagaagtcagacatcaagtggtacggcaagtacctaaacaaccctttgggacgcaccgtgatgttaacggttcagttcactctcggctgcccttagtacttag

SEQ ID NO: 18649 - DNA, 356 bp, Artificial
  Mutation in BnaC.FAD2.a introduced by TALE nuclease pair BnFAD2_T02
cctctcctccctcaccctctctcctacttcgcctggcctctctcctgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgggagagacgaagtgtttgtccccaagaagaaggcagacatcaagtggtacggcaagtacctcaacaacccgttgggacgcaccgtgatgttaacggttcatgtcactctcggctggcctttgtacttag

SEQ ID NO: 18650 - DNA, 330 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgacgccaccattccaacaccggatccctcgagagggatgaagtgttcgtccccaagaagaaatccgacatcaagtggtacggaaagtacctcaacaccccgctaggacgcccggtgatgctaaccgtccagttcacgctcggctggcctttgtacttag

SEQ ID NO: 18651 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcctctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctctgggacgcaccgtgatgttaacggttcagttcactctcggctggcctgtgtacttag

SEQ ID NO: 18652 - DNA, 341 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18653 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactta

SEQ ID NO: 18654 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgatgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18655 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtgatacggcaagtacctcaacaaccctttgggacgcaccgtgatgttaacggttcagttcactctcggctggcctttgtattag

SEQ ID NO: 18656 - DNA, 358 bp, Artificial
  Mutation in BnaC.FAD2.a introduced by TALE nuclease pair BnFAD2_T02
cctctcctccctcaccctctctcctacttcgcgtggcctctctactgggcctgccaagggtgcgtcctaaacggcgtctgggtcatagcccacgagtgcggccaccacgccttcagcgactaccagtggcttgaagacaccgtcgggttcatcttccactccttcctcctcgtcccttacttctcctggaagtgtcatcgacgccaccattccaacactggctccctcgagagagacgaagtgtttgtccccaagaagaagtcagacatcaagtggtacggcaagtccctcaacaacccgttgggacgcactgtgatgttaacggttcagttcactctcggctggcatttgtacgtag

SEQ ID NO: 18657 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18658 - DNA, 354 bp, Artificial
  Mutation in BnaC.FAD2.a introduced by TALE nuclease pair BnFAD2_T02
cctctcctccctcaccctctctcctacttcgcctggcctctctcctgggcctgccaagggtgcgtcctaaccggcgtctgggtcatagcccacgagtgcggcccccacgccttcagcgactaccagtggcttgacgacaccgtcggcctcatcttccactccttcctcctcgtcccttacttctcctcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18659 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaatggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 18660 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcatttcactctcggctggcctttgtacttag

SEQ ID NO: 18661 - DNA, 319 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18662 - DNA, 357 bp, Artificial
  Mutation in BnaC.FAD2.a introduced by TALE nuclease pair BnFAD2_T02
cctctcctccctcaccctctctcctacttcgcctgacctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcagcgtgatgttaacgggtcagttcactctcggctggcctttgtacttag

SEQ ID NO: 18663 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggctggcctttgtacttag

SEQ ID NO: 18664 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggccttggtacttag

SEQ ID NO: 18665 - DNA, 354 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18666 - DNA, 354 bp, Artificial
  Mutation in BnaC.FAD2.a introduced by TALE nuclease pair BnFAD2_T02
cctctcctccctcaccctctctcctacttcgcctggcctctctactgagcctgccaaggatgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaacccttggggacggaccgtgatgttaacggttcaggtcagtctcggctggcctttgtacttag

SEQ ID NO: 18667 - DNA, 321 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtcggtctcatcttccactccttcctcctcgtcccttacttctcctggaagagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18668 - DNA, 322 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18669 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaacccttttggacgctccgtgatgttaacggttcatttcactctcggctggcctttgtacttag

SEQ ID NO: 18670 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaagtcatcgacgccaccattccaacactggctccctcgagagagacgaagggtttgtccccaagaagaagccagacatcaagtggcccgggaagcaccccaacaagcgtccgggacggcctgtgatgttaacggttcaggtgactctaggccggcctcagcacttag

SEQ ID NO: 18671 - DNA, 329 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccacttacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctgtgtacttag

SEQ ID NO: 18672 - DNA, 336 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18673 - DNA, 354 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtaccgcaacaaccctttgggacgcaccgtgatgttaacggttcaggtcactctcggctggcctttgtacttag

SEQ ID NO: 18674 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccattggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18675 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18676 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatgtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 18677 - DNA, 321 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 18678 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggcctttgtacttag

SEQ ID NO: 18679 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagtgtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaccccttggggacgcaccgtgatgttaacggttcagttcactctcggctggcctttgtacttag

SEQ ID NO: 18680 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18681 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 18682 - DNA, 356 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaacgggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18683 - DNA, 350 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactcctttctcctcgtcccttactcctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18684 - DNA, 381 bp, Artificial
  Mutation in BnaC.FAD2.a introduced by TALE nuclease pair BnFAD2_T02
cctctcctccctccccctctctcctacttcgcctggcctctctactgggcctgccaagggtgcgtcctaaccggcgtctgggtcatagcccacgagtgcggccaccacgccttcagcgactaccagtggcttgacgacaccgtcggcctgggtcaagttgagcggggcacccgtcagtgcattgcgccatgcaggcggcaagcaggcgctggagacagtcatcgacgccaccattccaacactggctccctcgagagagacgaagtgtttgtccccaagaagaagtcagacatcaagtggtacggcaagtacctcaacaaccctttgggactcaccgtgatgttaacggttcagttcactctcggctggccttgtacttag

SEQ ID NO: 18685 - DNA, 384 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgcaatggcggtggcaagcaggcgctggagacggtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctgtgtacgtag

SEQ ID NO: 18686 - DNA, 362 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacgtttcagttcactctcggctggcctgtgtacttag

SEQ ID NO: 18687 - DNA, 359 bp, Artificial
  Mutation in BnaC.FAD2.a introduced by TALE nuclease pair BnFAD2_T02
cctctcctccctcaccatctctcctacttcgcctggcctctctactgggcctgccaagggtgcgtcctaaccggcgtctgggtcatagcccacgagtgcggccaccacgccttcagcgactaccagtggcttgacgacaccgtcggtctcatctgccactccttcctcctcggcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactatcggatgccctttgtacttag

SEQ ID NO: 18688 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 18689 - DNA, 350 bp, Artificial
  Mutation in BnaC.FAD2.a introduced by TALE nuclease pair BnFAD2_T02
cctctcctccttcaccctctctcctacttcgcctggcctctctactgggcctgccaagggcgcgtcctaaccggcgtctgggtcatagcccacgagtgcggccaccacgccttcagcgactaccagtggcttgacgacaccgtcggtctcatcttccactccttcctcctcgtcccttactaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttagtacttag

SEQ ID NO: 18690 - DNA, 362 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18691 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggcctttgtacttag

SEQ ID NO: 18692 - DNA, 331 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18693 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccaggtcatcgacgcaaccattccaacactggctccctcgagagagacgaagtgtttgtccccaagaagaagtcagacaacaagtgatacggaaagtacctcaacaacccgctagaacgcacggtgatgctaacggtcgaggtcacgcgcggctggcctttgtacttag

SEQ ID NO: 18694 - DNA, 291 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccatcagcgactaccagtggcttgacgacaccgtcggaagactggctccctcgagagagacgaactgtttgtccccaagaagaagtcagacatcaagtggtacggcaagtacctcaacaaccctttgggacgcaccgtgatgttaacggttcagttcactctcggctggcctttgtacttag

SEQ ID NO: 18695 - DNA, 370 bp, Artificial
  Mutation in BnaC.FAD2.a introduced by TALE nuclease pair BnFAD2_T02
cctctcctccctcaccctctcccttacctcgcctggactctctactgggcctgccaagggtgcgtcctaaccggcgtctgggtcatagcccacgagtgcggccaccacgccgtcagcgactaccagtggcttgacgacaccgtcggcctcatcttccactccttcctcctcgtcccttacttctcctggaagtaagaaaaatacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcaggtcactctcggctggccttggtacttag

SEQ ID NO: 18696 - DNA, 336 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttaagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18697 - DNA, 355 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaatcatcgacgccaccattcaaacactggctccctcgagagagacgaagtgtttgtccccaagaagaaggcagacatcaagtggtacggcaagtacctcaacaaccctttgggacgcaccgtgatgttaacggttcagttcactctcggctggcctttgtacttag

SEQ ID NO: 18698 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaatcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 18699 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctcgccgacgccgtcggtctcctcttcccctccttcctcctcgtcccttacttctcctggaagcatcgacgccaccatgccaacactggctccctcgagagagacgaagtgtttgtccccaagaagaagtcacacatcaagtggtacggcaagtacctcagcaacccttcgggacgcaccgtgatgttaacggctcagttccctctcggctgccctctgtacttag

SEQ ID NO: 18700 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 18701 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaagggcgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaattacctcaacaaccctgtgggacgcaccgtgatgttaacggttcagttcactctcggctggcctttgtacttag

SEQ ID NO: 18702 - DNA, 421 bp, Artificial
  Mutation in BnaC.FAD2.a introduced by TALE nuclease pair BnFAD2_T02
cctctcctccctcaccctctctcctacttcgtctggcctctctactgggcctgccaagggtgcgccctaaccggcgtctgggtcatagcccacgagtgcggccaccacgccttcagcgactaccagtggcttgacgacaccgtcggtctcatcttccactccttcctcctcgtcccttacttctcctggaagtaaggtttcatttagcgcctcaaatagatcctgttcaggaaccggatcaaagagttcctccgcagtcatcgacgccaccattccaacactggctccctcgagagagacgaagtgtttgtccccaagaagaagtcagacatcaagtggtccggcaagtacctcaacagccttaggggacgatcagtgacgttcacggttcagttcacgctccgctggcctttggacctag

SEQ ID NO: 18703 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacgggtcagttcactctcggctggcctttgtacttag

SEQ ID NO: 18704 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggcgcgtcctaaccggcgtctgggtcatagcccacgagtgcggccaccacgccttcagcgactaccagtggcttgacgacaccgtcggtctcatcttccactccttcctcctcgtcccttacttctcctggaagtcagtcatcgacgccaccattccaacactggctccctcgagagagacgaagtgtttgtccccaagaagaagtcagacatcaagtggtacggcaagtaccccaacaagcctgagggacgtacggggatgttaacggtccagttcactctcggctggcctttgtacttag

SEQ ID NO: 18705 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagtgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 18706 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18707 - DNA, 351 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcgacgccaccattccaacactggctccctcgagagagacgaagtgtttgtccccaagaagaagtcagacatcaagtggtacggcaagtacctcaacaaccctgtgggacgcaccgtgatgttaacggttcaattcactctcggctggcctttgtacttag

SEQ ID NO: 18708 - DNA, 412 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgccccttacttctcctggaagtcggtggacctctcaactctcccgccaccgtgagcaaggcctccagagcgcgtgcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18709 - DNA, 330 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgacgccaccattacaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18710 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgggatgttaacggttcaggtcactcgcggctggcctttgtacttag

SEQ ID NO: 18711 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggtctcatcttccactccttcctcctcgtcccttacttctcctggaaggcagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 18712 - DNA, 291 bp, Artificial
  Mutation in BnaC.FAD2.a introduced by TALE nuclease pair BnFAD2_T02
cctctcctccctcaccctctctcctacttcgtctggtctgcttcctgggccagccaagggagcgtcctaaccgccgtctgggtcatagcccacgagtgcggccaccacgccttcagcgactaccagtggcttgacgacaccgtcggaagactggctccctcgagagagacgaagtgtttgtccccaagaagaaatcccacatcaagtggtacggcaagtacctcaacaaccctttgggacgcaccgtgatgctaatgcttcatttcactctcggctggcctttgtacttag

SEQ ID NO: 18713 - DNA, 355 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaacgggcctctgggtcatcgcccacgaatgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaattacctcaacaaccctttgggacgcaccgtgatgttaacggttcagttcactctcggctggcctttgtacttag

SEQ ID NO: 18714 - DNA, 356 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18715 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctctcagccatcgacgacaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18716 - DNA, 379 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggtcgttcggctgcggcgagcggtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18717 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18718 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacatcccgctaggacgcacggtgatgctaaccgtccagttcacgctcggctggcctttgtacttag

SEQ ID NO: 18719 - DNA, 412 bp, Artificial
  Mutation in BnaC.FAD2.a introduced by TALE nuclease pair BnFAD2_T02
cctctcctccctcaccctctctcctacttcgcctggcctctctactgcgcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcggtggacctctcaactctcccgccaccgtgagcaaggcctccagagcgcgtgcgtcatcgacgccaccattccaacactggctccctcgagagagacgaagtgtttgtccccaagaagaagtcagacatcaagtggtacggcaagtaccgcaacaaccctttgggacgcaccgggagggtaacgggtcagttctctctcggcgggccttggtacttag

SEQ ID NO: 18720 - DNA, 340 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgaatgcggccaccacgccttcagcgaccaccagtggcttgacgacaccgtcggtctcatcttccactccttcctcctcgtcagtcatcgacgccaccattccaacactggctccctcgagagagacgaagtgtttgtccccaagaagaagtcagacatcaagtggtacggcaagtacctcaacaaccctttgggacgcaccgtgagtttaacggtgcaggtcactctcggcggcccttagtacttag

SEQ ID NO: 18721 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18722 - DNA, 412 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcggtggacctctcaactctcccgccaccgtgagcaaggcctccagagcgcgtgcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18723 - DNA, 345 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttcttcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18724 - DNA, 344 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcactctcggctggcctttgtacttag

SEQ ID NO: 18725 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 18726 - DNA, 351 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctgcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18727 - DNA, 458 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaagcggtccagcggctgttgccaccatcattgctggcgatggccaccacctgctggggggtcaagccgtggccctggcccagcaccggcaacagccgctggagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18728 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggtctcatcttccactccttcctcctcgtcccttacttctcctggacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18729 - DNA, 355 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18730 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtactag

SEQ ID NO: 18731 - DNA, 292 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18732 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18733 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 18734 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagagactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgccctttgtacttag

SEQ ID NO: 18735 - DNA, 347 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggcctttgtacttag

SEQ ID NO: 18736 - DNA, 359 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctgtgggacgcaccgggatgttaacggttcagttcactctcggctggcctttgtacttag

SEQ ID NO: 18737 - DNA, 356 bp, Artificial
  Mutation in BnaC.FAD2.a introduced by TALE nuclease pair BnFAD2_T02
ctctcctccctcaccctctctcctacttcgcccggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18738 - DNA, 291 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacgacaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18739 - DNA, 420 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtactggaccgtctccagcgcctgcttgaaagataccaggcgtttccccctggaagctccctcagtcatcgacgccaccatgccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18740 - DNA, 336 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagtgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcgtctggcctttgtacttag

SEQ ID NO: 18741 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccatcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctgtgggacgcaccgggatgttaacggttcagttcactctcggcgggcctttgtacttag

SEQ ID NO: 18742 - DNA, 408 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagttgagcggggcacccgtcagtgcattgcgccatgcatgcactgcctccaaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 18743 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18744 - DNA, 291 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggaagactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18745 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttat

SEQ ID NO: 18746 - DNA, 358 bp, Artificial
  Mutation in BnaC.FAD2.a introduced by TALE nuclease pair BnFAD2_T02
cctctcctccctcaccctctctcctacttcgcctggcctctctcctgagcctgcaaaggacgcgtccccaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattcccacaccggatccctcgagagggatgaagtgttcgtccccaagaagaagccagacatcacgtggtacgggaagtacctcaacaaccgtttgggacgcagcgtgagtttaagggtgcaggtcagtctcggctggccttagtacttag

SEQ ID NO: 18747 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagcagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 18748 - DNA, 336 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 18749 - DNA, 359 bp, Artificial
  Mutation in BnaC.FAD2.a introduced by TALE nuclease pair BnFAD2_T02
cctctcctccctcaccctctctcctacttcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18750 - DNA, 342 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtccctgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18751 - DNA, 346 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacagtcatcgacgccaccattccaacactggctccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 18752 - DNA, 359 bp, Artificial
  Mutation in BnaC.FAD2.a introduced by TALE nuclease pair BnFAD2_T02
cctctcctccctcaccctctctcctacttcgcctggcctctctcctgggcctgccaagggtgcgtcctcaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacacgcgctccctcgagagagacgaagtgtttgtccccaagaagaagtcagacatcaagtggtacggcaagtacctcaacacccctctggaacgccccgtgatgttaacggttcagttcactctcggctgcccttagtacttag

SEQ ID NO: 18753 - DNA, 345 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttcttcgacgccaccattccaacactggctccctcgagagagacgaagtgtttgtccccaagaagaagtcagacatcgagtggtacggcaagtacctcaacaaccctttgggacgctccgtgatgttaacggttcagttcactctcggctggcctttgtacttag

SEQ ID NO: 18754 - DNA, 358 bp, Artificial
  Mutation in BnaC.FAD2.a introduced by TALE nuclease pair BnFAD2_T02
cctctcctccctcaccctctctcctacttcgcctggactctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 18755 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 18756 - DNA, 358 bp, Artificial
  Mutation in BnaC.FAD2.a introduced by TALE nuclease pair BnFAD2_T02
cctctcctccctcaaccctctctcctacttcgcctggcctctctactgggcctgccaagggtgcgtcctaaccggcgtctgggtcatagcccacgagtgcggccaccacgccttcagcgactaccagtggcttggcgacaccgtcggtctcatcttccactccttcctcctcgtcccttacttctcctggaaagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 18757 - DNA, 336 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggcctttgtacttag

SEQ ID NO: 18758 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaatcgacgccaccattccaacactggctccctcgagagggatgaagcgttcgtccccaagaagaaatccgacatcaagtggtacggaaagtacctcaacaacccgctaggacgcacggtgatgctaaccgcccagttcacgctcggctggcctttgtgcttag

SEQ ID NO: 18759 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcgtcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18760 - DNA, 354 bp, Artificial
  Mutation in BnaC.FAD2.a introduced by TALE nuclease pair BnFAD2_T02
cctctcctccctcaccctctcccttacctcgcctgtcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcacacatcaagtggtacggcaagtacctcaaccacccttagagacgcaccgtggtgagaaccgcttcgctcactctcggctggcctttgtacttag

SEQ ID NO: 18761 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 18762 - DNA, 310 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18763 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaatggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18764 - DNA, 341 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaattccaacactggctccctcgagagagacgaagtgtttgtccccaagaagaagtcagacatcaagtggtacggcaagtacctcaacaaccctttgggacgcaccgtgatgttaacggttcagttccctctcggctggcctttgtacttag

SEQ ID NO: 18765 - DNA, 355 bp, Artificial
  Mutation in BnaC.FAD2.a introduced by TALE nuclease pair BnFAD2_T02
cctctcctccctcaccctctctcctacttcgtctggcctctctactgagcctgccaagcgtgcgccctaaccggcgtctgggtcatagcccacgattgcggccaccacgccttcagcgactaccagtggcttgacgacaccgtcggtctcatcttccactccttcctcctcgtcccttacttctcctggaaacatcgacgccaccattccaacactggctccctcgagagagacgaagtgtttgtccccaagaagaaggcagacatcaagtggtacggcaatgtccgcagcgaccgtttgggatgtgtaagagacagcgcggttaagttcactctcggctggcctttgtacttag

SEQ ID NO: 18766 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagggatgaagtgttcgtccccaagaagaagtcagacatcaagtggtacggaaagtacctcaacaacccgctaggacgcacggtgatgctaaccgtccagttcacgctcggctggcctttgtacttag

SEQ ID NO: 18767 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18768 - DNA, 392 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcccaaccggcgtctgggtcatagcccacgagtgcggccaccacgccttcagcgactaccagtggcttgacgacaccgtcggtctcctcttccactccttcctcctcgtcccttacttctcctggagactgagcctttcgttttatctgttgtttgtcggtgaacgctcgacgccaccattccaacactggctccctcgagagagacgaagtgtttgtccccaagaagaagtcagacatcaagtggtacggcaagtacctcaacaaccctttggtacgcaccgtgatgttaacggtgcatgtcactctcggctggcctgtatacttag

SEQ ID NO: 18769 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagtgactaccagtggcttgacgacaccgtcggtctcatcttccactccttcctcctcgtcccttacttctcctggaagagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 18770 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactatcagtggcttgacgacaccgtcggcctcatcttccactccttcctcctcgtcccttacttctcctggaagtagtcatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18771 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18772 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaatggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggaaagtacctcaacaacccgcgaggacgcacggtgatgctaaccgtccagttcacgctcggctggcctttgtacttag

SEQ ID NO: 18773 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgtgtcatagcccacgagtgcggccaccacgccttcagcgactaccagtggcttgacgacaccgtcggtctcatcttccgctccttcctcctcgtcccttacttctcctggaaagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 18774 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtgacttgacgacactgtcggtctcatcttccactccttcctcctcgtcccttacttctccttgtcatcgacgccaccattccaacactggctccctcgagagagacgaagtgtttgtccccaagaagaagtcagacatcaagtggtacggcaagtacctcaacaaccctttgggacgcaccgtgatcttaacggttcattttactctcggctggcctttgtacttag

SEQ ID NO: 18775 - DNA, 388 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaggcctttttacggttcctggccttttgcgtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggccggcctttgtacttag

SEQ ID NO: 18776 - DNA, 348 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcgtctgggtaatagcccacgagtgcggccaccacgccttcagcgactaccagtggcttgacgacaccgtcggtctcctcttccactccttcctcctcgtcccttacttctccatcgacgccaccattccaacaccggatccctcgagagggatgaagtgtttgtccccaagaagaagtcagacatcaagtggtacggcaagtacctcaacaaccctgtgggacgcaccgtgatgataacggttcagttcactctcggctggcctttgtacttag

SEQ ID NO: 18777 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttaattctcctggacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18778 - DNA, 318 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagacgaagtgtttgtccccaagaagaagtcagacatcaagtggtacggcaagtacctcaacaaccctttgggacgcaccgtgatgttaacggttcagttcacgctcggctggtctttgtacttag

SEQ ID NO: 18779 - DNA, 356 bp, Artificial
  Mutation in BnaC.FAD2.a introduced by TALE nuclease pair BnFAD2_T02
cctctcctccctcaccctctctcctacttcgcctggcctctctcctgggcctgccaaggatgcgtcctaaccggcgtctgggtcatctcccacgagtgcggccaccacgccttcagcgactaccagtggcttgacgacaccgtcggtctcatcttccactccttcctcctcgtcccttacttctcctggaagtcgtcgacgccaccattccaacactggctccctcgagagagacgaagtgtttgtccccaagaagaagtcagacatcaagtggtacggcaagtaccgcaacacccttgtgggacgcaccgggaggttaacggttcaggtcactcctggttggcctttgtacgtag

SEQ ID NO: 18780 - DNA, 409 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaccttgaccgaacgcagcggtggtaacggcgcagtggcggttttcatggcttgagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18781 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacactgtcggtctcatcttccactccttcctcctcgtcccttacttctcctggaagtcatcgacgccaccactccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 18782 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccttggggacgcaccgtgaggttaacggttcagttcactctcggctggcctttgtacttag

SEQ ID NO: 18783 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaacgggcgtctgggtcatagcccacgagtgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18784 - DNA, 349 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttaatcgtgtcatcgacgccaccattccaacactggctccctcgagagagacgaagtgtttgtccccaaaaagaagtcagacatcaagtggtacggaaagtacctcaacaacccgcgaggacgcacggtgatgctaaccgtccagttcacgctcggctggcctttgtacttag

SEQ ID NO: 18785 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttggttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18786 - DNA, 357 bp, Artificial
  Mutation in BnaC.FAD2.a introduced by TALE nuclease pair BnFAD2_T02
cctctcctccctcaccctctctcatacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaaggcagacatcaagtggtacggcaagtaccgcaacaaccctttgggacgcaccgtgatgttaatggtgcaggtcactctcggctgtcctttgtacttag

SEQ ID NO: 18787 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacaacggcgagctttgatcaacgaccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 18788 - DNA, 321 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18789 - DNA, 352 bp, Artificial
  Mutation in BnaC.FAD2.a introduced by TALE nuclease pair BnFAD2_T02
cctctcctccctcaccctctctcctacttcgcctggcctctctcctgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18790 - DNA, 303 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccatcgacgccaccattccaacactggctccctcgagagagacgaagtgtttgtccccaagaagaagtcagacatcaagtggtacggcaagtacctcaacaaccctttgggacgcaccgttatgttaacgggtcagttctctctcggctggcctttgtgcttag

SEQ ID NO: 18791 - DNA, 415 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcggcgactaccagtggcttgacgacaccgtcggtctcatcttccactccttcctcctcgtcccttacttctcctggaagtccgcctttgagtgagctgataccgctcgccgcagccgaacgaccgagcgcagcgagagtcatcgacgccaccattccaacactggctccatcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18792 - DNA, 347 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18793 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcagtcatcgacgccaccattccaacactggctccctcgagagagacgaagtgtttgtccccaagaagaagtcagacatcaagtggtacggcaagtacctcaacatccgttttggacgcaccgtggtgttaacggttcagttcactctcggctggcatttgtacttag

SEQ ID NO: 18794 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgcgatgttaacggttcagttcactctcggctggcctttgtacttag

SEQ ID NO: 18795 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgatcgacgccaccattccaacactggctccctcgagagagacgaagtgtttgtccccaagaagaagtcagacatcaagtggtacggcaagtacctcaacaaccctttgggacgcacagtgatgttaacggttcagttcactctcggctggcctttgcacttag

SEQ ID NO: 18796 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggacatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 18797 - DNA, 331 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18798 - DNA, 336 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18799 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgagtacttag

SEQ ID NO: 18800 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18801 - DNA, 363 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtacacagtcatcgacgccaccattccaacactggctccctcgagagagacgaagtgtttgtccccaagaagaagtcagacatcaagtggtacggcaactaccccaacaaccctgtgggacgcgccgggagggtaacggtgcaggtcactctcggtgggctttggtccttag

SEQ ID NO: 18802 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 18803 - DNA, 345 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttcttcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18804 - DNA, 321 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18805 - DNA, 358 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18806 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattcaaacactggctccctcgagagagacgaagtgtttgtccccaagaagaagtcagacatcaagtggtacggcaagtacctcaacaaccctttgggacgcagggggatgctaaccgtccagttcacgctcggctggcattcgtacttag

SEQ ID NO: 18807 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18808 - DNA, 358 bp, Artificial
  Mutation in BnaC.FAD2.a introduced by TALE nuclease pair BnFAD2_T02
cctctcctccctcaccctctatcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18809 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 18810 - DNA, 351 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcgcccaccacgccttcagcgactaccagtggcttgacgacaccgtcggtctcatcttccactccttcctcctcgtctcttacttctcctggaacgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18811 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactgactccctcgagagagacgaagtgtttgtccccaagaagaaatctgacatcaagtggtacggaaagtacctcaacaacccgctaggacgcacggtgatgctaaccgtccagttcacgctcggctggcctttgtacttag

SEQ ID NO: 18812 - DNA, 332 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 18813 - DNA, 321 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgatggccaccacctgctgaggggtcaagccgtgggcctggcacagcaccggcaacagccgctagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18814 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagatagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18815 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggcttgcctgtgtacttag

SEQ ID NO: 18816 - DNA, 358 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagtatcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 18817 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 18818 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 18819 - DNA, 358 bp, Artificial
  Mutation in BnaC.FAD2.a introduced by TALE nuclease pair BnFAD2_T02
cctctcctccctcaccctctatcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18820 - DNA, 456 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagctactaccagtggcttgacgacaccgtcggtctcatcttccactccttcctcctcgtcccttacttctcctggaagtacaaacaacgcggcgagctttgatcaacgaccttttggaaacttcggcttccccttaacgcaggaaagaacatgtgagcaaaaggccagcaaaaggcagtcatcgacgccaccattccaacactggctccctcgagagagacgaagtgtttgtccccaagaagaagtcagacatcaagtggtacggcaagtacctcaacatcccttggggacgcaccgtgatgttaacggttcagttcactcgcggctggcctttgtacttag

SEQ ID NO: 18821 - DNA, 291 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18822 - DNA, 357 bp, Artificial
  Mutation in BnaC.FAD2.a introduced by TALE nuclease pair BnFAD2_T02
cctctcctccctcaccctctcccttacctcgcctggtccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18823 - DNA, 414 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagaccccccagcaggtggtggccatcgccagcaataatggtggcaagcaggcgctggagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18824 - DNA, 344 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactcatcgacgccaccattccaacaccggatccctcgagagggatgaagtgtttgtccccaagaagaagtcagacatcaagtggtacggcaagtacctcaacaaccctttgggacgcaccgtgattttaacggttcagttcactctcggctggcctttgtacttag

SEQ ID NO: 18825 - DNA, 360 bp, Artificial
  Mutation in BnaC.FAD2.a introduced by TALE nuclease pair BnFAD2_T02
gctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 18826 - DNA, 350 bp, Artificial
  Mutation in BnaC.FAD2.a introduced by TALE nuclease pair BnFAD2_T02
cctctgctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctagtcatcgacgccaccattccaacactggctccctcgagagagacgaagtgtttgtccccaagaagaagtcagacatcaagtggtacggcaagtgcctcaacaaccctttgggacgcaccgtgatgctaaccgtccagttcacgcgcggctggcattagtacttag

SEQ ID NO: 18827 - DNA, 372 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactcaagtcagaggtggcgaaacccgacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgcacttag

SEQ ID NO: 18828 - DNA, 346 bp, Artificial
  Mutation in BnaC.FAD2.a introduced by TALE nuclease pair BnFAD2_T02
cctctcctccctcaccctctcccttacctcgcctggcccctctcctgagcctgccaaggctgcgtcccaacgggcctctgggtcatcgcccacgaatgcggccaccacgccttcagcgactaccagtggattgacgacaccgtcggtctcatcttccactccttcctcctcgtcccttacagtcatcgacgccaccattccaacactggctccctcgagagagacgaagtgtttgtccccaagaagaagtcagacatcaagtggtacggcaagtacctcaccaaccgtttgggacggcccgggattttaacgtttcagttgactctcggctggctttagtacttag

SEQ ID NO: 18829 - DNA, 336 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctgtgtacttag

SEQ ID NO: 18830 - DNA, 351 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcgacgccaccattccaatactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 18831 - DNA, 404 bp, Artificial
  Mutation in BnaC.FAD2.a introduced by TALE nuclease pair BnFAD2_T02
cctctcctccctcaccctctcccttacctcgcctggaccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaagtatctccagcgcctgcttgccaccgccattgctggcgatggccaccagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcgctctcggctggcctgtgtacttag

SEQ ID NO: 18832 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacgggtcagttcactctcggctggcctttgtacttag

SEQ ID NO: 18833 - DNA, 360 bp, Artificial
  Mutation in BnaC.FAD2.a introduced by TALE nuclease pair BnFAD2_T02
cctctcctccctcaccctctctcctacttcgcctgccctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 18834 - DNA, 312 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcgacgccaccattccaacactggctccctcgagagagacgaagtgtttgtccccaagaagaagtcagacatcaagtggtacggcaagtacctcaacaaccctttgggatgcaccgtgatgttaacggttcagttcactctcggctggcctttgtacttag

SEQ ID NO: 18835 - DNA, 395 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagccgccggagtaggccttggtgtccacgatcacgccgtagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 18836 - DNA, 353 bp, Artificial
  Mutation in BnaC.FAD2.a introduced by TALE nuclease pair BnFAD2_T02
cctctcctccctcaccctctctcctacttcgcctggcctctctactgcgcctgccaagggtgcgtcctaaccggcgtctgggtcatagcccacgagtgcggccaccacgccttcagcgactaccagtggcttgacgacaccgtcggtctcctcttccactccttcctcctcgtcccttacttctccttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18837 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctgtgtgacgcaccgtgatgttaacggttcagttcactctcggctggcctttgtacttag

SEQ ID NO: 18838 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 18839 - DNA, 388 bp, Artificial
  Mutation in BnaC.FAD2.a introduced by TALE nuclease pair BnFAD2_T02
cctctcctccctcaccctctctcctacttcgcctggactccctactgggcctgccaagggtgcgtcccaaccggcgtctgggtcatagcccacgagtgcggccaccacgccttcagcgactaccagtggcttgacgacaccgtcggtctcatcttccactccttcctcctcgtcccttacttctcctggaagccttctgcttagtttgatgcctggcagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18840 - DNA, 345 bp, Artificial
  Mutation in BnaC.FAD2.a introduced by TALE nuclease pair BnFAD2_T02
cctctcctccctcaccctctctcctacttcgcctggcctctctactgagcctgccaagggtgcgtcctaaccggcgtctgggtcatagcccacgagtgcggccaccacgccttcagcgactaccagtggcttgacgacaccgtcggtctcatcttccactccttcctcctcgtcccttacttcatcgacgccaccattccgacactggctccctcgagagagacgaagtgtttgtccccaagaagaagtcagacatcaagtggtacggaaagtacctcaacaacccgctaggacgcacggtgatgctaaccgtccaggtcacgctcggctggcctttgtacttag

SEQ ID NO: 18841 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 18842 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaaagtcatcgacgccaccattccaacactggctccctcgagagagacgaagtgtttgtccccaagaagaagtcagacatcaagtggtacggaaaggacctcaacaacccgctaggacgctcgctgatgctaaccgtccggttcaggctcggcgggccttagtacttag

SEQ ID NO: 18843 - DNA, 358 bp, Artificial
  Mutation in BnaC.FAD2.a introduced by TALE nuclease pair BnFAD2_T02
cctctcctccctcaccctttatactacttcgcctggccactctaatgggcctgccaagggtgcgtcctaaccggcgtctgggtcatagcccacgagtgcggccaccacgccttcagcgactaccagtggcttgacgacaccgtcgggctcatcttccactccttcctcctcgtcccttacttctcctggaaaagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttatacttag

SEQ ID NO: 18844 - DNA, 420 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtactggaccgtctccagcgcctacttgaaagataccaggcgtttccccctggaagctccctcagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 18845 - DNA, 303 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagctactaccagtggcttgacgacaccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18846 - DNA, 436 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagcggtggtttttttgtttgcaagcagcagattacgcgcagaaaaaaaggatctcaagtgaccttaggcgacttttgaacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 18847 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttaactctcggctggcctttgtacttag

SEQ ID NO: 18848 - DNA, 407 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacggtgctgttccgggcgatctcgatcagctcgatgtactcgtgggacagtcatcgacgccaccattccaacactggctccctcgagagggatgaagtgttcgtccccaagaagaaatccgacatcaagtggtacggaaagtacctcaacaaccctttgggacgcacggtgatgctaaccgtccagttcacgctcggctggcctttgtacttag

SEQ ID NO: 18849 - DNA, 348 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18850 - DNA, 291 bp, Artificial
  Mutation in BnaC.FAD2.a introduced by TALE nuclease pair BnFAD2_T02
cctctcctccctcaccctctctcctacttcgcctggcctctctcctgggcctgccaagggtgcgtcctaaccggcgtctgggtcatagcccacgagtgcggccaccacgccttcagcgactaccagtggcttgacgacaccgtcggaagactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18851 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagcagtcatcgacgccaccattccaacactggctccctcgagagagacgaagtgtttgtccccaagaagaagtcagacatcaagtggtacggcaagtacctcaacaacccgttgggacgcaccgtggtgttaacggttcagttctctcctggctggcctttgtacttag

SEQ ID NO: 18852 - DNA, 303 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 18853 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgactacaccgtcggtctcatcttccactccttcctcctcgtcccttacttctcctggaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 18854 - DNA, 344 bp, Artificial
  Mutation in BnaC.FAD2.a introduced by TALE nuclease pair BnFAD2_T02
cctctcctccctcaccctctctcctacttcgcctggcctctctaccgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggacaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18855 - DNA, 357 bp, Artificial
  Mutation in BnaC.FAD2.a introduced by TALE nuclease pair BnFAD2_T02
cctctcctccctcaccctctctcctacttcgcctggcctctctactgggcctgtcaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18856 - DNA, 312 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttaacgacaccgtcggtctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18857 - DNA, 352 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggcatcgacgccaccattccaacactggctccctcgagagagacgaagtgtttgtccccaagaagaagtcagacatcaagtggtacggcaagtaccgcaacaacccttggggacgcgccgtgatgttaacggttcatgtcactctcggctggcctttgtacttag

SEQ ID NO: 18858 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccaccccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18859 - DNA, 362 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtacaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 18860 - DNA, 355 bp, Artificial
  Mutation in BnaC.FAD2.a introduced by TALE nuclease pair BnFAD2_T02
cctctcctccctcaccctctctcctacttcgcctggcccctctactgggcctgccaagggtgcgtcctaaccggcgtctgggtcatagcccacgagtgcggccaccacgccttcagcgactaccagtggctggacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18861 - DNA, 372 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactcaagtcagaggtggcgaaacccgacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 18862 - DNA, 322 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 18863 - DNA, 382 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttggcgacaccgtcggtctcatcttccactccttcctcctcgtcccttacttctcctggaagtctccagcggctgttgccggtgccagtcatcgacgccaccattccaacaccagatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 18864 - DNA, 355 bp, Artificial
  Mutation in BnaC.FAD2.a introduced by TALE nuclease pair BnFAD2_T02
cctctcctccctcaccctctctactacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttggacttag

SEQ ID NO: 18865 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggcttgacgacaccgtcggtctcatcttccactccttcctcctcgtcccttacttctcctggatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18866 - DNA, 349 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18867 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18868 - DNA, 366 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacaatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18869 - DNA, 349 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttaatcgtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 18870 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18871 - DNA, 356 bp, Artificial
  Mutation in BnaC.FAD2.a introduced by TALE nuclease pair BnFAD2_T02
cctctcctccctcaccctctctcctacttcgcctggcctctctactgggcctgcctagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaaggcacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 18872 - DNA, 342 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtccctgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18873 - DNA, 467 bp, Artificial
  Mutation in BnaC.FAD2.a introduced by TALE nuclease pair BnFAD2_T02
cctctcctccctcaccctctctcctacttcgcctggcctctctactgtgcctgccaagggtgcgtcctaaccggcgtctgggtcatcgcccacgaatgcggccaccacgccttcagcgactaccagtggcttgacgacaccgtcggtctcatcttccactccttcctcctcgtcccttacttctcctggaagggaccgtctccagcgcctgcttgccaccattattgctggcgatggccaccacctgctggggggtcaagccgtgggcctggcacagcaccggcaacagccgctggaccgtctccatcgacgccaccattccaacactggctccctcgagagagacgaagtgtttgtccccaagaagaagtcagacatcaagtggtacggcaagttcctcaacatccctttgggacgcaccgtgatgttaacggttcagttcactctcggctggcctttgtacttag

SEQ ID NO: 18874 - DNA, 359 bp, Artificial
  Mutation in BnaC.FAD2.a introduced by TALE nuclease pair BnFAD2_T02
cctctcctccctcaccctctctcctacttcgcctggcctctctactgtgcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18875 - DNA, 291 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggaagactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18876 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 18877 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttcacgacaccgtcggtctcctcttccactccttcctcctcgtcccttacttctcctggaagtagtcatcgacgccaccattccaacactggctccctcgagagagacgaagtgtttgtccccaagaagaagtcacacatcaactggtacggcaagtacctcaacatccctctgggacgccccgtgatgttaacggttcagttccctctcggctggcctttgtacttag

SEQ ID NO: 18878 - DNA, 356 bp, Artificial
  Mutation in BnaC.FAD2.a introduced by TALE nuclease pair BnFAD2_T02
cctctcctccctcaccctctctcctacttcgcctggcctctctactggacctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 18879 - DNA, 357 bp, Artificial
  Mutation in BnaC.FAD2.a introduced by TALE nuclease pair BnFAD2_T02
cctctcctccctcaccctatctactacttcgcctcgactctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgttgttaacggttcagttcactctcggctggcctttgtacttag

SEQ ID NO: 18880 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcctctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacacccctgtgggacgcgccgggatgttatcggttcagttcactcccggtgggccttggtacgtag

SEQ ID NO: 18881 - DNA, 355 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggactcatcgacgccaccattccaacactggctccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 18882 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggctggcctttgtacttag

SEQ ID NO: 18883 - DNA, 311 bp, Artificial
  Mutation in BnaC.FAD2.a introduced by TALE nuclease pair BnFAD2_T02
cctctcctccctcaccctctctcctacttcgcctggccactctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcgtctttgtccccaagaagaagtcagacatcaagtggtacggcaagtacctcaacaaccctttgggacgcaccgtgatgttaacggttcagttcactctcggctggcctttgtacttag

SEQ ID NO: 18884 - DNA, 357 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtccattacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcgggccgttgtacttag

SEQ ID NO: 18885 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggaaagtacctcaacaacccgctagggcgcacggtgctgctaaccgtaccgttcacgctcggctggcctttgtacttag

SEQ ID NO: 18886 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18887 - DNA, 349 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctgggcgggcctttgtacttag

SEQ ID NO: 18888 - DNA, 434 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatggcggcaagcaggcgctggagacggtccagcggctgttgccggtgctgtgccaggcccacggcttgaccccccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 18889 - DNA, 346 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcgatctcatcttccactccttcctcctcgtcccttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18890 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccagggtgcgtcctaaccggcgtctgggtcatagcccacgagtgcggccaccacgccttcagcgactaccagtggcttgacgacaccgtcggtctcatcttccactccttcctcctcgtcccttacttctcctggacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18891 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttctctcccggctggcctttggacttag

SEQ ID NO: 18892 - DNA, 366 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacaatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18893 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaaccctttgggacgcgccgtgatgttaaccgtccagtgcacgctcgggtggcctttgtacttag

SEQ ID NO: 18894 - DNA, 347 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgcctgggtcatagcccacgagtgcggccaccacgccttcagcgactaccagtggcttgacgacaccgtcggtctcatcttccactccttcctcctcgtcccttacttctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18895 - DNA, 356 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18896 - DNA, 329 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccacttacagtcatcgacgccgccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18897 - DNA, 356 bp, Artificial
  Mutation in BnaC.FAD2.a introduced by TALE nuclease pair BnFAD2_T02
cctctcctccctcaccctatcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18898 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcgtcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 18899 - DNA, 362 bp, Artificial
  Mutation in BnaC.FAD2.a introduced by TALE nuclease pair BnFAD2_T02
cctctcctccctcacactctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18900 - DNA, 393 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggagactgagcctttcgttttatctgttgtttgtcggtgaacgctcgccagcaaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 18901 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcaacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18902 - DNA, 348 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18903 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcggcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18904 - DNA, 310 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgctgccaccacgccttcagcgaccaccagtggcttgacgacaccgtcggtctcatcttccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 18905 - DNA, 355 bp, Artificial
  Mutation in BnaC.FAD2.a introduced by TALE nuclease pair BnFAD2_T02
cctctcctccctcaccctctctcctacttcgcctggactctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18906 - DNA, 347 bp, Artificial
  Mutation in BnaC.FAD2.a introduced by TALE nuclease pair BnFAD2_T02
cctctcctccctcaccctctctcctacttcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccacgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18907 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtatgtccccaagaagaagtcagacatcaagtggtacggaaagtacctcaacaacccgctaggacgcacggtgatgctaaccgtccagttcacgctcggctggcctttgtacttag

SEQ ID NO: 18908 - DNA, 291 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18909 - DNA, 351 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 18910 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18911 - DNA, 360 bp, Artificial
  Mutation in BnaC.FAD2.a introduced by TALE nuclease pair BnFAD2_T02
cctctcctccctcaccctatcccttacctcgcctggcccctctcctaggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtacgtcatcgacgccaccattccaacactggctccctcgagagagacgaagtgtttgtccccaagaagaagtcagacagcaagtggtacggcaagtacctcaacaaccctttgggacgcaccgtgatgttaacggttcagttcactctctgcgggcctttgtacttag

SEQ ID NO: 18912 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18913 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctcccgcgagagagacgaagtgtttgtccccaagaagaagtcagacatcaagtggtacggcaagtacctcaacaaccctttgggacgcaccgtgatgttaacggttcagttcactctcggctggccttagtacttag

SEQ ID NO: 18914 - DNA, 311 bp, Artificial
  Mutation in BnaC.FAD2.a introduced by TALE nuclease pair BnFAD2_T02
cctctcctccctcccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18915 - DNA, 355 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgaccaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18916 - DNA, 342 bp, Artificial
  Mutation in BnaC.FAD2.a introduced by TALE nuclease pair BnFAD2_T02
cctctcctccctcaccctctaccttacctcgcctggacccactactgggcctgccaagggtgcgtcctaaccggcgtctgggtcatagcccacgagtgcggccaccacgccttcagcgactaccagtggcttgacgacaccgtcggtctcatcttccactccttcctcctcgtccctgtcatcgacgccaccattccaacactggctccctcgagagagacgaagtgtttgtccccaagaagaagtcagacatcaagtggtacggcaagtacctcaacagccctgtgggacgcgccggattggtaacggttcagttcactcttggcgggccgtggtacgtag

SEQ ID NO: 18917 - DNA, 412 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcggtggacctctcaactctcccgccaccgtgagcaaggcctccagagcgcgtgcgtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 18918 - DNA, 350 bp, Artificial
  Mutation in BnaC.FAD2.a introduced by TALE nuclease pair BnFAD2_T02
cctctcctccctcaccctctctcctacttcgcctggcccctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18919 - DNA, 350 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttactaacagtcatcgacgccaccattccaacactggctccctcgagagagacgaagtgtttgtccccaagaagaagtcagacatcaagtggtacggcaagtacctcaacaacccgttgggacgcaccgggatgttaacggttcagttcactcgcggctggcctttgtacttag

SEQ ID NO: 18920 - DNA, 358 bp, Artificial
  Mutation in BnaC.FAD2.a introduced by TALE nuclease pair BnFAD2_T02
cctctcctccctcaccctctatcctacttcgcctggcctctctactgggcctgccaagggtgcgtcctaaccggcgtctgggtcatagcccacgagtgcggccaccacgccttcagcgactaccagtggctggacgacaccgtcggtctcatcttccactccttcctcctcgtcccttacttctcctggaagagccatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 18921 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggactcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18922 - DNA, 342 bp, Artificial
  Mutation in BnaC.FAD2.a introduced by TALE nuclease pair BnFAD2_T02
cctctcctccctcaccctctcggctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcgacgccaccattccaatactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 18923 - DNA, 343 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactatcgacgccaccattccaacaccggatccctcgagagggatgaagtgttcgtccccaagaagaaatccgacatcaagtggtacggaaagtacctcaacaacccgctaggacgcacggtgatgctaaccgtccatttcacgctcggctggcctttgtacttag

SEQ ID NO: 18924 - DNA, 311 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcgtctttgtccccaagaagaagtcagacatcaagtggtacggcaagtacctcaacaaccctttgggacgcaccgtgatgttaacggttcagttcactctcggctggcctttgtacttag

SEQ ID NO: 18925 - DNA, 357 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 18926 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 18927 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 18928 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18929 - DNA, 350 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactaacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 18930 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 18931 - DNA, 358 bp, Artificial
  Mutation in BnaC.FAD2.a introduced by TALE nuclease pair BnFAD2_T02
cctctcctccctcaccctctctactacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctctgggacgccccgtgatgttaacggttcaggtcactctcggctggcctttgtacttag

SEQ ID NO: 18932 - DNA, 364 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggcttgacgacaccgtcggtctcatcttccactccttcctcctcgtcccttacttctcctggaagtattacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18933 - DNA, 355 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18934 - DNA, 347 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactacctgtggcttgacgacaccgtcggtctcatcttccactccttcctcctcgtcccttacttctcatcgacgccaccattccaacactggctccctcgagagagacgaagtgtttgtccccaagaagaagtcagacatcaagtggtacggcaagtgcctcaacaaccctttgggacgcaccgtgatgttaacggttcagttcactctcggctggcctttgtacttag

SEQ ID NO: 18935 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 18936 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18937 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttgtcatcgacgccaccattccaacactggctccctcgagagagacgaagtgtttgtccccaagaagaagtcagacatcaagtggtacgacaagtacctcaacaaccctttgggacgcaccgggatgttaacggttcagttcactctcggctagcctttgtacttag

SEQ ID NO: 18938 - DNA, 427 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctccagcgcctgcttgccaccattattgctggcgatggccaccacctgctggggggtcaagccgtgggcctggcacagcaccggacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18939 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctttacgacaccgtcggtctcatcttccactccttcctcctcgtcccttacttctcctgtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagtacactctcggctggcctttgtacttag

SEQ ID NO: 18940 - DNA, 336 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18941 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaatggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgatgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18942 - DNA, 351 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 18943 - DNA, 389 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatggtggccatcgccagcaatggcggtgacagtcatcgacgccaccagtccaacactggctccctcgagagagacgaagtgtttgtccccaagaagaagtcagacatcaagtggtacggcaagtacctcaacaaccctttgggacgcaccgggatgttaacggttcagttcaccctcggctggccttagtacttag

SEQ ID NO: 18944 - DNA, 318 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagacgaagtgtttgtccccaagaagaagtcagacatcaagtggtacggcaagtacctcaacaacccgttgggacgcaccgtgatgttaacggttcagttcacgctcggctggcctttgtacttag

SEQ ID NO: 18945 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 18946 - DNA, 319 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18947 - DNA, 323 bp, Artificial
  Mutation in BnaC.FAD2.a introduced by TALE nuclease pair BnFAD2_T02
cctctcctccctcaccctctcccttacctcggctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtaccgctcgccgcagccgaacgaccgagaagaagtcagacatcaagtggtacggcaagtacctcaacaaccctttgggacgcaccgtgatgttaacggttcagttcactctcggctggcctttgtacttag

SEQ ID NO: 18948 - DNA, 336 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctttacgacaccgtcggtctcatcttccactccttcctcctcgtcatcgacgccaccattccaacactggctccctcgagagagacgaagtggttggccccaagaagaagtcagacatcaagtggtacggcaaggtcctcaacaacccttggggacgcaccgtgatgttaacggttcatttctctctcggctcgcctttatacttag

SEQ ID NO: 18949 - DNA, 441 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcctcttccactccttcctcctcgtcccttacttctcctggaagtgtgccaggcccacggcttgaccccccagcaggtggtggccatcgccggccagcaacgtcggttcgagatggcgctcgatgacggtcagcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18950 - DNA, 352 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18951 - DNA, 351 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttcacctggatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18952 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccatggctgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcgacacccctttgggacgcaccgtgatgttaatccttcagttcactctcggctggcctttgtacttag

SEQ ID NO: 18953 - DNA, 310 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18954 - DNA, 356 bp, Artificial
  Mutation in BnaC.FAD2.a introduced by TALE nuclease pair BnFAD2_T02
cctctcctccctcaccctctctactacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18955 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgactaccagtggcttgacgacaccgtcggtctcatcttccactccttcctcctcgtcccttacttctcctggagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18956 - DNA, 310 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18957 - DNA, 350 bp, Artificial
  Mutation in BnaC.FAD2.a introduced by TALE nuclease pair BnFAD2_T02
cctctcctccctcaccctctctcctacttcgcctggcctctctactgggcctgccaagggtgtgtcctaaccggcgtctgggtcatagcccacgagtgcggccaccacgccttcagcgactaccagtggcttgacgacaccgtcggtctcatcttccactccttcctcctcgtcccttacttctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18958 - DNA, 449 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgactaccagtggcttgacgacaccgtcggtctcatcttccactccttcctcctcgtcccttacttctcctggaatcacggcctggcacagcaccggcaacagccgctggaccgtctccagcgcctgcttgccaccgccattgctggcgatggccaccacctgctacagtcatcgacgccaccattccaacactggctccctcgagagagacgaagtgtttgtccccaagaagaagtcagacatcaagtggtacggcaagtacctcaacaaccctttgggacgcaccgtgatgttaatgtttcagttcactctcggctggcctttgtacttag

SEQ ID NO: 18959 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgcgcggctggcctttgtacttag

SEQ ID NO: 18960 - DNA, 358 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaagtttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttctacttag

SEQ ID NO: 18961 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgtggccaccacgccttcagcgactaccagtggcttgacgacaccgtcggtctcatcttccactccttcctcctcatcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18962 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacgacaagtacctcaacaaccctttgggacgcaccgtgatgttaacggttcagttcactctcggctggcctttgtacttag

SEQ ID NO: 18963 - DNA, 310 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggcttgacgacaccgtcggtctcatcttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18964 - DNA, 409 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagcaacagccgctggaccgtctccagcgcctgcttgccgccatcgtggctggcgagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18965 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacatccctctgggacgcaccgtgatgttaaccgttcagttcactctaggctggcctttgtacctag

SEQ ID NO: 18966 - DNA, 336 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18967 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 18968 - DNA, 347 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcatcgacgccaccattccaacacaggctccctcgagagagacgaagtgtttgtccccaagaagaagtcagacatcaagtggtacggcaagtacctaaacaagccttggggacggaccgagatgaaaacggttcagttcacgcacggcaggcctttgtacttag

SEQ ID NO: 18969 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18970 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacaaatcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 18971 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtactgag

SEQ ID NO: 18972 - DNA, 370 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagggaccgtctccagcgcctgcttgccaccattccaacaccggatccctcgagagggatgaagtgttcgtccccaagaagaagtcagacatcaagcggtacggcaagtacctcaacaaccctttgggacgcaccgtgatgttaacggttcagttcactctcggctggcctttgtacttag

SEQ ID NO: 18973 - DNA, 359 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18974 - DNA, 310 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttctaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18975 - DNA, 354 bp, Artificial
  Mutation in BnaC.FAD2.a introduced by TALE nuclease pair BnFAD2_T02
cctctcctccctcaccctctcccctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18976 - DNA, 342 bp, Artificial
  Mutation in BnaC.FAD2.a introduced by TALE nuclease pair BnFAD2_T02
cctctcctccctcaccctctctcctacttcgcctggcctctctactgggcctgccaagggtgcctcctaaccggcgtctgggtcatagcccacgagtgcggccaccacgccttcagcgactaccagtggcttgacgacaccgtcggtctcatcttccactccttcctcctcgtccctgtcatcgacgccaccattccaacaccgaatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 18977 - DNA, 432 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtggaccgtctccagcgcctgcttgccaccgccattgctggcgatggccaccacctgctggggggtcaagttgagcgggtggtacggcaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18978 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctgtgggacgcaccgtgatgttaacggtgcagttcactctcggctggcctttgtacttag

SEQ ID NO: 18979 - DNA, 364 bp, Artificial
  Mutation in BnaC.FAD2.a introduced by TALE nuclease pair BnFAD2_T02
cctctcctccctcaccctgtcccttacctcggctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttacacagtcatcgacgccaccattccaacactggctccctcgagagagacgaagtgtttgtccccaagaagaagtcagacatcaagtggtacggcaagtacctcaacaacccttcgggacgcaccgtgatgttaacggttcagttcactctcggctggcctttgtacttag

SEQ ID NO: 18980 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttgtcatcgacgccaccattccaacactggctccctcgagagagacgaagtgtttgtccccaagaagaagtcagacatcaagtgatacggcaagtacctcaacaaccctgtgggacgcaccgtgatgttaacggttcagttcactctcggctggcctgtgtacttag

SEQ ID NO: 18981 - DNA, 331 bp, Artificial
  Mutation in BnaC.FAD2.a introduced by TALE nuclease pair BnFAD2_T02
cctctcctccatcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18982 - DNA, 363 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagtatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18983 - DNA, 357 bp, Artificial
  Mutation in BnaC.FAD2.a introduced by TALE nuclease pair BnFAD2_T02
cctctcctccctcaccctctcccttacctcgcctggcccctctcctgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18984 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagccatcaagtggtacggcaagtacctcaacaaccctttgggacgcaccgtgatgttaacggttcagttcactctcggctggcctgtgtacttag

SEQ ID NO: 18985 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgactaccagtggcttgacgacaccgtcggtctcatcttccactccttcctcctcgtcccttacttctcctggaacatcgacgccaccattccaacacgggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18986 - DNA, 358 bp, Artificial
  Mutation in BnaC.FAD2.a introduced by TALE nuclease pair BnFAD2_T02
cctctcctccctcaccctctctcctagttcgtctggccactctactcttcctcccaagtgtgcgtcctgaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtcccgcaagtcccccaccacccctgtgggacgcaaggtgctgttacccgtcccgttccctctcggctggcctttgtacttag

SEQ ID NO: 18987 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacaccggatccctcgagagggatgaagtgttcgtccccaagaagaaatccgacatcaagtggtacggcaagtacctcaacaaccctttgggacgcaccgtgatgttaaccgttcagttcactctcggctggcctttgtacttag

SEQ ID NO: 18988 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggtttagttcactctcggctggcctttgtacttag

SEQ ID NO: 18989 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacgtcatcgacgccaccattccaacactggctccctcgagagagacgaagtgtttgtccccaagaagaagtcagacatcaagtggtacggcaagtacctcaacatccctttgggacgcaccgtgatgttaacggttcagttcactctcggctggcctttgtacttag

SEQ ID NO: 18990 - DNA, 365 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaactacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18991 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 18992 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18993 - DNA, 454 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaccgtctccagcgcctgcttgccaccattattgctggcgatggccaccacctgctggggggtcaagccgtgggcctggcacagcaccggcaacagccgcttgtcatcgacgccaccattccaacactggctccctcgagagagacgaagtgtttgtccccaagaagaagtaagacatcaagtggtacggcaagtacctcaacaaccctttgggacgcaccgtgatgttaacggttcagttcactctcggctggcctttgtattag

SEQ ID NO: 18994 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggacgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18995 - DNA, 395 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagccgccggagtaggccttggtgtccacgatcacgccgtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 18996 - DNA, 291 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggaagactggctccctcgagagagacgaagtgtttgtccccaagaagaagtcagacatcaagtggtacggcaagtacctcaacaaccctttgggacgcaccgtgatgttaacggttaagttcactctcggctggcctttgtacttag

SEQ ID NO: 18997 - DNA, 291 bp, Artificial
  Mutation in BnaC.FAD2.a introduced by TALE nuclease pair BnFAD2_T02
cctctcctccctcaccctctctcctacttcgcctgccctctctactgggcctgccaagggtgcgtcctaaccggcgtctgggtcatagcccacgagtgcggccaccacgccttcaacgactaccagtggctggacgacaccattccaacactggctccctcgagagagacgaagtgtttgtccccaagaagaagtcagacatcaagtggtacggcaagtacctcaacaaccctttgggacgcaccgtgatgttaaccgttcagttccctctcggctggcctttgtacttag

SEQ ID NO: 18998 - DNA, 332 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcgaccaccacgccttcagcgactaccagtggcttgacgacaccgtcggtctcatcttccactccttcctcctcgtcccttacttctcctggaactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 18999 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 19000 - DNA, 444 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatcttcgagccagccacgatcgacattgatctggctatcttgctgacaaaggcgctggagacggtccagcggctgttgccggtgctgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19001 - DNA, 403 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagcaagatcgcttggcctcgcgcgcagatcagttggaagaatttgtccgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19002 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacagttcagttcactctcggctggccgttgtacttag

SEQ ID NO: 19003 - DNA, 394 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggacgccattgctggcgatggccaccacctgctggggggtcagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggcaggcctttgtacttag

SEQ ID NO: 19004 - DNA, 351 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctccttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19005 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatgtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19006 - DNA, 423 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatagtcttccgactgagcctttcgttttatttgatgcctggcagttccctactctcgcgttcgaatacatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19007 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19008 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctcgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtgcctcaacagccctttgggacgcaccgtgatgttaacggttcagttcactctcggctggcattagtacttag

SEQ ID NO: 19009 - DNA, 315 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccaatggcggtggcaagcaggcgctggagccatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 19010 - DNA, 339 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccaccatttcaacactggcttcctcgagagagacgaagtgtttgtccccaagaagaagtcagacatcaagtggtacggcaagtacctcaacaaccctttgggatgcaccgtgatgttaacggttcagttcactctcggctggcctttgtacttag

SEQ ID NO: 19011 - DNA, 330 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19012 - DNA, 336 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttgggacgcgccgtaatgttaacggttcagttcactctcggctggcctttgtacttag

SEQ ID NO: 19013 - DNA, 335 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactcaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19014 - DNA, 357 bp, Artificial
  Mutation in BnaC.FAD2.a introduced by TALE nuclease pair BnFAD2_T02
cctctcctccctcaccctctctcctacttcgcctggcatctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19015 - DNA, 354 bp, Artificial
  Mutation in BnaC.FAD2.a introduced by TALE nuclease pair BnFAD2_T02
cctctcctccctcaccctctcccttacctcgcctggcacctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggcctgtgtacttag

SEQ ID NO: 19016 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 19017 - DNA, 347 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctactcgtcccttacttctcatcgacgccaccattccaacactggctccctcgagagagacgaagtgtttgtccccaagaagaagtcagacatcaagtggtacggcaagtacctcaacaaccctttgggacgcaccgtgatgttaacagttcagttcactctcggctggcctttgtacttag

SEQ ID NO: 19018 - DNA, 364 bp, Artificial
  Mutation in BnaC.FAD2.a introduced by TALE nuclease pair BnFAD2_T02
cctctcctccctcaccctctctcctacttcgcctgacctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttacacagtcatcgacgccaccattccaacactggctccctcgagagagacgaagtgtttgtccccaagaagaagtcagacatcaagtggtacggcaagtacctcaacaacccgctaggacgcacggtgatgctaagcgtccagttcacgctcggctggcctttgtacttag

SEQ ID NO: 19019 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 19020 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 19021 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19022 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaagagtcatcgacgccaccattccaacactggctccctcgagagagacgaagtgtttgtccccaagaagaagtcagacatcaagtggtacggcaagtacctcaacatccctttgggacgcaccgtgatgttaacggttcagttcactctcggctggcctttgtacttag

SEQ ID NO: 19023 - DNA, 356 bp, Artificial
  Mutation in BnaC.FAD2.a introduced by TALE nuclease pair BnFAD2_T02
cctctcatccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19024 - DNA, 363 bp, Artificial
  Mutation in BnaC.FAD2.a introduced by TALE nuclease pair BnFAD2_T02
cctctcctccctcaccctctctcctacttctcctggcctctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaccaccccagatggatgcacggtgatgctaatcgtacagttccctctcggctggcctttgtacttag

SEQ ID NO: 19025 - DNA, 388 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagccttctgcttagtttgatgcctggcagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19026 - DNA, 384 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagccacgatggcggcaagcaggcgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19027 - DNA, 400 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggcttgacgacaccgtcggtctcatcttccactccttcctcctcgtcccttacttctcctggaagtgccaggcccacggcttgaccccggagcaggtggtggccatcgcctggcacagcaccggcaacagccgctggaccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19028 - DNA, 346 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19029 - DNA, 358 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19030 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19031 - DNA, 310 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggcaaccacgccttcagcgaccaccagtggcttgacgacaccgtcggtctcatcttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 19032 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtgtcttgacgacaccgtcggtctcatcttccactccttcctcctcgtcccttacttctcctggaatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 19033 - DNA, 350 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttgctaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19034 - DNA, 404 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttggcgacaccgtcggtctcatcttccactccttcctcctcgtcccttacttctcctggaagtatctccagcgcctgcttgccaccgccattgctggcgatggccaccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19035 - DNA, 359 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcggttcactctcggctggcctttgtacttag

SEQ ID NO: 19036 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 19037 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19038 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctgtgggacgcacggtgatgctaaccgtccagttcacgctcggctggcctttgtacttag

SEQ ID NO: 19039 - DNA, 341 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 19040 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccatgccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19041 - DNA, 356 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19042 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19043 - DNA, 421 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaaggtttcatttagcgcctcaaatagatcctgttcaggaaccggatcaaagagttcctccgcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19044 - DNA, 356 bp, Artificial
  Mutation in BnaC.FAD2.a introduced by TALE nuclease pair BnFAD2_T02
cctctactccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19045 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccgacgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgtgggacgcaccgtgatgttaacggttcaggtcactctcggctggcctttgtacttag

SEQ ID NO: 19046 - DNA, 407 bp, Artificial
  Mutation in BnaC.FAD2.a introduced by TALE nuclease pair BnFAD2_T02
cctctcctccctcaccctctctcctacttcgcctcgcctctctactcggcctgccaagggtgcgtcctaccgggcctctgggtcatcgcccacgaatgcggccaccacgccttcagcgactaccagtggcttgacgacaccgtcggtctcctcttccactccttcctcctcgtcccttacttctcccggaagtacggtgctgttccgggcgatctcgatcagctcgatgtactcgtgggacagtcatcgacgccaccattccaacactggctccctcgagagagacgaagtgtttgtccccaagaagaagtcacacatcaagtggtacggcaagtacctcagcaaccgtctgagaggcaccgtgatgtgaaccgttcagttcacgctcggctggcctctgtacttag

SEQ ID NO: 19047 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtcaccaagaagaagtcagacatcaagtggtacggcaagtacctcaacaaccctttgggacgcaccgtgatgttaacggttcagttcactctcggctggcctttgtacttag

SEQ ID NO: 19048 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19049 - DNA, 354 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19050 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatacagtcatcgacgccaccattccaacactggctccctcgagagggatgaagtgttcgtccccaagaagaagtcagacatcaagtggtacggcaagtacctcaacaaccctttgggacgcaccgtgatgttaacggtgcagttcactctcggctggcctttgtacttag

SEQ ID NO: 19051 - DNA, 336 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggccgttgtacttag

SEQ ID NO: 19052 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagtgactaccagtggcttgacgacaccgtcggtctcatcttccactccttcctcctcgtcccttacttctcctggagtgtcatcgacgccaccattccaacgctggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19053 - DNA, 341 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtccagtcatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 19054 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcgacgccaccattccaacactggctccctcgagagagacgaagtgtttgtccccaagaagaagtcagacatcaagtggtacggcaagtacctcaacaaccctttgggacgcaccgtgatgttaaccgttcagttcactctcggctggcctgtgtacttag

SEQ ID NO: 19055 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19056 - DNA, 384 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgggcgctcggtcgttcggctgcggcgagcggagtcatcgacgccaccattccaacactggctccctcgagagagacgaagtgtttgtccccaagaagaaatccgacatcaagtggtacggcaagtacctcaacaaccctttgggacgcaccgtgatgttaacggttcagttcactctcggctggcctttgtacttag

SEQ ID NO: 19057 - DNA, 423 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacagcaccggcaacagccgctggacgccctgatccggcgttggccgcgttgaccaacgaccacctgacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19058 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaattcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 19059 - DNA, 342 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgactacaccgtcggtctcatcttccactccttcctcctcgtcccttactatcgacgccaccattccaacactggctccctcgagagagacgaagtgtttgtccccaagaagaagtcagacatcaagtggtacggcaagtacctcaacaacccttgggacgcaccgtgatgttaacggttcagttcactctcggctggcctttgtacttag

SEQ ID NO: 19060 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccataaaacaaagttaaacattgggcttcctggagccgcccatcgacgccaccattccaacactggctccctcgagagagacgaagtgtttgtccccaagaagaagtcagacatcaagtggtacggcaagtacctcagcaaccctttgggacgcaccgtgatgttaacggttcaggtcactctcggctgccctttgtacttag

SEQ ID NO: 19061 - DNA, 362 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcttctgggtcatcgcccacgaatgcggccaccacgccttcagcgactaccagtggcttgacgacaccgtcggtctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 19062 - DNA, 341 bp, Artificial
  Mutation in BnaC.FAD2.a introduced by TALE nuclease pair BnFAD2_T02
cctctcctccctcaccctctctcctacttcgcctggcctctctactgggcctgccaatggtgcgtcctaaccggcgtctgggtcatagcccacgagtgcggccaccacgccttcagcgactaccagtggcttgacgacaccgtcggtctcatcttccactccttcctcctcgtccagtcatcgacgccaccattccaacactggctccctctagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19063 - DNA, 414 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagaccccccagcaggtggtggccatcgccagcaataatggtggcaagcaggcgctggagagtcatcgacgccaccattccaacaccggatccctcgagagggatgaagtgttcgtccccaagaagaaagccgacatcaagtggtacggaaagtacctcaacaacccgctaggacgcacggtgatgctaaccgtccagttcacgctcggctggcctttgtacttag

SEQ ID NO: 19064 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19065 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtacagtcatcgacgccaccattccaacactggctccctcgagagagacgaagtgtttgtccccaagaagaagtcagacatcaagtggtacggcaagtacctcaacaaccgtttgggacgcaccgtgatgttaacggttcagttcactctcggctggcctttgtacttag

SEQ ID NO: 19066 - DNA, 445 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttgcgcgttcaaaagtcgcctaaggtcactatcagctagcaaatatttcttgtcaaaaatgctccactgacgtggtccagcggctgcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19067 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatagacgccaccattccaacactggctccctcgagagagacgaagtgtttgtccccaagaagaaatccgacatcaagtggtacggaaagtacctcaacaacccgctaggacgcaccgtgatgttaacggttcagttcactctcggctggcctttgtacttag

SEQ ID NO: 19068 - DNA, 351 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19069 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttcacgacaccttcggtctcatcttccactccttcctcctcgtcccctacttctcctggaagtcatcgacgccaccattccaaccctggctccctcgagagagacgaactgtttgtccccaagaagaagccagacatcaactggtccggcaagtacctcaacaaccctctgggacgcaccgtgatgttaacggttcagttcactctcggctggcctttgtacttag

SEQ ID NO: 19070 - DNA, 471 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatacaaataaaacgaaaggcccagtcttgctggcgatggcaagcaggcgctggagacgctggagagcattgttgcccagttatctcgccctgatccggcgttggccgcgttgaccagtcatcgacgccaccattccaacactggctcccacgagagagacgaagtgtttgtccccaagaagaagtcacacatcaagtggtacggcaagtacctcagcaagcgtttgggacgcaccgtggtgttaaccgttcggttcactctaggatggcctttgtacttag

SEQ ID NO: 19071 - DNA, 344 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggacaccattccaacactggctccctcgagagagacgaagtgtttgtccccaagaagaagtcagacatcaagtggtacggcaagtccctcaacaaccctttgggacgcaccgtgatgttaacggttccgttcactctcggctggcctttgtacttag

SEQ ID NO: 19072 - DNA, 417 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtccacgatcacgccgtagtcgatgggggagcccaatcctgttgccggtcttgcgatgattatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 19073 - DNA, 363 bp, Artificial
  Mutation in BnaC.FAD2.a introduced by TALE nuclease pair BnFAD2_T02
cctctcctccctcaccctctctcctacttctcctgccccctctactctgcctgccaagggtgcgtcctaaccggcgtctgggtcatagcccacgagtgcgtccaccacgccttcagcgactaccagtggcttgacgacaccgtcggtctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtagctcacaacccctgtgggacgcaacgggatgctaacccttcagttccctctcggctggcctttgtacttag

SEQ ID NO: 19074 - DNA, 310 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 19075 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtaccttaacagccctttgggacgcaccgtgatgttaacggttcagttcactctcggctggcctttgtacttag

SEQ ID NO: 19076 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctccttgtcatcgacgccaccattccaacactggctccctcgagagggatgaagtgttcgtccccaagaagaaatccgacatcaagtggtacggaaagtacctcaacaacccgctaggactcacggtgatgctaaccgtccagttcacgctcggctggcctttgtacttag

SEQ ID NO: 19077 - DNA, 356 bp, Artificial
  Mutation in BnaC.FAD2.a introduced by TALE nuclease pair BnFAD2_T02
cctctcctccctcaccctctctcctacttcgcctggcatctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 19078 - DNA, 358 bp, Artificial
  Mutation in BnaC.FAD2.a introduced by TALE nuclease pair BnFAD2_T02
cctctcctccctcaccctttctcctacttcgcctggcctctctactgggcctgccaagggtgcgtcctaaccggcgtctgggtcatagcccacgagtgcggccaccacgccttcagcgtctaccagtggcttgacgacaccgtcggtctcatcttccactccttcctcctcgtcccttacttctcctggaagtgtcatcgacgccaccattccaactctggctccctcgagagagacgaagtgtttgtccccaagaagaagtcaaacatcaagtggtacggcaagtacctcaacaaccctttggaacgcaccgtgatgttaacggttcagttcactctcggctggcctttgtacttag

SEQ ID NO: 19079 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccatcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19080 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggccgttgtacttag

SEQ ID NO: 19081 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtactta

SEQ ID NO: 19082 - DNA, 358 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 19083 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacaacggcgagcttttatcaacgaccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19084 - DNA, 329 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccacttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19085 - DNA, 356 bp, Artificial
  Mutation in BnaC.FAD2.a introduced by TALE nuclease pair BnFAD2_T02
cctctcctccctcaccctgtctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcacacatcaagtggtacggcaagtacctcaacaaccctttgggacgcaccgtgatgttaacggttcagttcactctcggctggcctttgtacttag

SEQ ID NO: 19086 - DNA, 353 bp, Artificial
  Mutation in BnaC.FAD2.a introduced by TALE nuclease pair BnFAD2_T02
cctctcctccctaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19087 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19088 - DNA, 291 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccatcagcgactaccagtggcttgacgacaccgtcggaagactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 19089 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 19090 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcgtccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 19091 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagtgtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 19092 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccccttgggacgcaccgtgatgttaacggttcagttcactctcggctggcctttgtacttag

SEQ ID NO: 19093 - DNA, 330 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19094 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19095 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19096 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagcagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 19097 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcagtcatcgacgccaccattccaacactggctccctcgagagagacgaagtgtttgtccccaagaagaaatccgacatcaagtggtacggaaagtacctcaacaacccgctaggacgcacggtgatgctaaccgtgcagttcacgctcggctggcctgtgtacttag

SEQ ID NO: 19098 - DNA, 361 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcgacgggcttttgtactta

SEQ ID NO: 19099 - DNA, 344 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19100 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaaagtcatcgacgccaccattccaacactggctccctcgagagagacgaagtgtttgtccccaagaagaagtcacacatcaagtggtacggcaagtacctcaacaagcctctgggacgccccgtgatgttaacggttcagttcactctcggatggcctttgtacttag

SEQ ID NO: 19101 - DNA, 303 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccatcgacgccaccattccaacactggctccctcgagagagacgaactgtttgtccccaagaagaagtcagacatcaagtggtacggcaagtacctcaacaaccctttgggacgcaccgtgatgttaacggttcagttcactctcggctggcctttgtacttag

SEQ ID NO: 19102 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctgtgtacttag

SEQ ID NO: 19103 - DNA, 294 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctccttgtcaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19104 - DNA, 349 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 19105 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggacgtcatcgacgccaccattccaacactggctccctcgagagagacgaagtgtttgtccccaagaagaagtcagacatcaagtggtacggcaagtacctcaacaaccctttgggacgcaccgtgattttaaccgttcagttcactctcggctggcctttgtacttag

SEQ ID NO: 19106 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 19107 - DNA, 360 bp, Artificial
  Mutation in BnaC.FAD2.a introduced by TALE nuclease pair BnFAD2_T02
cctctcctccctcaccctctctcctacttcgcctggcctctcttctgggcctgccaagggtgcgccctaaccggcgtctgggtcatagcccacgagtgcggccaccacgccttcagcgactaccagtggcttgacgacaccgtcggtctcatcttccactccttcctcctcgtcccttacttctcctggaagtaagtcatcgacgccaccattccaacaccggatccctcgagagggatgaagtgttcgtccccaagaagaaatccgacatcaagtggtacggaaagtacctcagcaaccggctaggacgcacggtggggctaaccgtgcaggtcacgctcggctggcctttgtacttag

SEQ ID NO: 19108 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19109 - DNA, 357 bp, Artificial
  Mutation in BnaC.FAD2.a introduced by TALE nuclease pair BnFAD2_T02
cctctcctccctcaccctctctcctacttcgcctggcctctatactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacaacggcgagctttgatcaacgaccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 19110 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagtgcacgctcggctggcctttgtacttag

SEQ ID NO: 19111 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtaggtctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19112 - DNA, 342 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtccctgtcatcgacgccaccattccgacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19113 - DNA, 365 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaagtacaaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19114 - DNA, 435 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacaacgaacaggtcactatcagtcaaaataaaatcattatttgccatgtcggttcgagatggcgctcgatgacgccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 19115 - DNA, 292 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19116 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19117 - DNA, 358 bp, Artificial
  Mutation in BnaC.FAD2.a introduced by TALE nuclease pair BnFAD2_T02
cctctcctccctcaccctctctcccacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19118 - DNA, 351 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcgacgccaccattccaatactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19119 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagtaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19120 - DNA, 349 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttccgtcatcgacgccaccattccaacactggctccctcgagagagacgaagtgtttgtccccaagaagaagtcagacatcaagtggtacggcaagtacctcaacaaccctgtgggacgcaccgtgatgttaaccgtccagttcacgctcggctgccctttgtacttag

SEQ ID NO: 19121 - DNA, 332 bp, Artificial
  Mutation in BnaC.FAD2.a introduced by TALE nuclease pair BnFAD2_T02
cctctgctccctcaccctctctcctacttcgcctggcatctctaatgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaactggctccctcgagagagacgaagtgtttgtccccaagaagaagtcagacatcaagtggtacggcaagtacctcaacaaccctttgggacgcaccgtgatgttaacgtttcagttcactctcggctggcctgtgtacttag

SEQ ID NO: 19122 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaaatcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 19123 - DNA, 345 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19124 - DNA, 356 bp, Artificial
  Mutation in BnaC.FAD2.a introduced by TALE nuclease pair BnFAD2_T02
cctctcctccctcaccctctctcctacttcgcctggcctctctactgggcatgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaagtcatcgacgccaccattccaacactggctccctcgagagagacgaagtgtttgtccccaagaagaagtcaaacatcaagtggtacggcaagtacctcaacaaccctttgggacgcaccgtgatgttaaccgtccagttcacgctcggctagcctttgtacttag

SEQ ID NO: 19125 - DNA, 363 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtatacagtcatcgacgccaccattccaacaccggatccctcgagagggatgaagtgttcgtccccaagaagaaatccgacatcaagtggtacggaaagtacctcaacaacccgctaggacgcaccgtgatgttaacggttcagttcactctcggctggcctttgtacttag

SEQ ID NO: 19126 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttagtacttag

SEQ ID NO: 19127 - DNA, 359 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19128 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 19129 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaagtaacagccatcgacgccaccattccaacaccggatccctcgagagggatgaagtgttcgtccccaagaagaaatccgacatcaagtggtacggcaagtacctcaacaaccctttgggacgcaccgtgatgttaacgtttcagttcactctcggctggcctgtgtacttag

SEQ ID NO: 19130 - DNA, 359 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19131 - DNA, 345 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttcttcgacgccaccattccaacactggctccctcgagagagacgaagtgtttgtccccaagaagaagtcagacatcaagtggtacggcaagtacctcaacaaccctgtgggacgcaccgggatgttaacggttcagttcactctcggcgggcctttgtacttag

SEQ ID NO: 19132 - DNA, 356 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19133 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttggtacgcaccgtgatgttaacggttcagttcactctcggctggcctttgtacttag

SEQ ID NO: 19134 - DNA, 384 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctgcaatggcggtggcaagcaggcgctggagacggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 19135 - DNA, 340 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcagccatcgacgcaaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19136 - DNA, 365 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaactacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19137 - DNA, 345 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacattccaacactggctccctcgagagagacgaagtgtttgtccccaagaagaagtcagacatcaagtggtacggcaagtacctcaacaaccctttggaacgcaccgtgatgttaacggttcagttcactctcggctggcctttgtacttag

SEQ ID NO: 19138 - DNA, 355 bp, Artificial
  Mutation in BnaC.FAD2.a introduced by TALE nuclease pair BnFAD2_T02
cctctcctccctaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19139 - DNA, 348 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttcttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 19140 - DNA, 412 bp, Artificial
  Mutation in BnaC.FAD2.a introduced by TALE nuclease pair BnFAD2_T02
cctctcctccctcaccctctctcctacttcgcctggcctctctactgtgcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcggtggacctctcaactctcccgccaccgtgagcaaggcctccagagcgcgtgcgtcatcgacgccaccattccaacactggctccctcgagagagacgaagtgtttgtccccaagaagaagtcagacatcaagtggtacggcaagtaccgcaacgacccttggggacgcaagatgatgttaacggttcagttcactctcggctggccgttgtacttag

SEQ ID NO: 19141 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctgtgtacttag

SEQ ID NO: 19142 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19143 - DNA, 331 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctccatcgacgccaccattccaacactggctccctcgagagagacgaagtgtttgtccccaagaagaaatccgacatcaagtggtacggaaagttcctcaacaacccgctaggacgcacggtgatgctaaccgtccagttcacgctcggctggcctttgtacttag

SEQ ID NO: 19144 - DNA, 349 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttaatcgtgtcatcgacgccaccattccaacactggctccctcgagagagacgaagtgtttgtccccaagaagaagtcagacatcaagtggtacggcaagtacctcaacacccctttgggacgcaccgtgatgttaacccttcagttcactctcggctggcctttgtacttag

SEQ ID NO: 19145 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgtgtcatagcccacgagtgcggccaccacgccttcagcgactaccagtggcttgacgacaccgtcggtctcatcttccactccttcctcctcgtcccttacttctcctggaagtaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19146 - DNA, 323 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaagtaccgctcgccgcagccgaacgaccgagaagaagtcagacatcaagtggtacggcaagtacctcaacaaccctttgggacgcaccgtgatgttaacggttcagttcactctcggctggcctttgtacttag

SEQ ID NO: 19147 - DNA, 335 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgaccccgtcggtctcatcttccactccttcctcctcgtcccttactcaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19148 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgtgacgcaccgtgatgttaacggttcagttcactctcggctggcctttgtacttag

SEQ ID NO: 19149 - DNA, 310 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 19150 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctctgggacgcaccgtgatgttaaccgtccagttcacgctcggctggcctttgtacttag

SEQ ID NO: 19151 - DNA, 345 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactccttcctcctcgtcccttacttctcctggaagtacagtccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19152 - DNA, 353 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactgactccctcgagagagacgaagtgtttgtccccaagaagaagtcagacatcaagtggtacggcaagtacctcaacaaccctttgggacgcaccgtgatgttaacggttcagttcactctcggctggcctttgtacttg

SEQ ID NO: 19153 - DNA, 360 bp, Artificial
  Mutation in BnaC.FAD2.a introduced by TALE nuclease pair BnFAD2_T02
cctctcctccctcaccctctctcctacttcgcctggcatctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttagtacttag

SEQ ID NO: 19154 - DNA, 336 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19155 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctgagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19156 - DNA, 356 bp, Artificial
  Mutation in BnaC.FAD2.a introduced by TALE nuclease pair BnFAD2_T02
cctctcctccctcaccctctctactacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaactgttcagttcgctctcggctggcctttgtacttag

SEQ ID NO: 19157 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcaactaccagtggcttgacgagaccgtcgaacccatcttccactccttcctcctcgtcccttacttctcctggaaagtcatcgacgccaccagtccaacactggctccctcgagagagacgaagtgtttgtccccaagaagaagtcaaacatcaagtggtacggcaagtacctcaacaaccctttgggacgcaccgtgatgttaaccgttcagttcactctcggctggcatttgtacttcg

SEQ ID NO: 19158 - DNA, 294 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctccttgtcaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 19159 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgacaaccagtggcttgacgacaccgtcggtctcatcttccactccttcctcctcgtcccttacttctcctggaaagtacagtcatcgacgccaccattccaacactggctccctcgagagagacgaagtgtatgtccccaagaagaagtcagacatcaagtggtacggcaagtacctcaacaaccctttgggacgctccgtgatgttaacggttcagttcacactcggctggcctttgtacttag

SEQ ID NO: 19160 - DNA, 379 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcgggctcatcttccactccttcctcctcgtcccttacttctcctggctccgcccccctgacgagcatcacagtcatcgacgccaccattccaacactggctccctcgtgagggatgaagtgttcgtccccaagaagaaatccgacatcaagtggtacggcaagtacctcaacaaccctttgggacgcaccgtgatgttaacggttcagttcactctcggctggcctttgtacgtag

SEQ ID NO: 19161 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 19162 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19163 - DNA, 355 bp, Artificial
  Mutation in BnaC.FAD2.a introduced by TALE nuclease pair BnFAD2_T02
cctctcctccctcaccctctctcctacttcgcctcgcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttagtacttag

SEQ ID NO: 19164 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctctgctggcctttgtacttag

SEQ ID NO: 19165 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19166 - DNA, 332 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19167 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctaggctggcctttgtacttag

SEQ ID NO: 19168 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19169 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggcatcgacgccaccattccaacactggctccctcgagagagacgaagtgtttgtccccaagaagaagtcagacatcaagtggtacggcaagtacctcaacaacactttgggacgcaccgtgatgttaacggttcagttcactctcggctggcctttgtacttag

SEQ ID NO: 19170 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccaatggcttgacgacaccatcggtctcatcttccactccttcctcctcctcccttacatctcctggaaagtacagtcatcgacgccaccattccaacactggctccctcgagagagacgaagtgtttgtacccacgaaaaagtcagacatcaagtcgtacggcaagtacctcaacagccctatgaaacgcacagtgatgctaacactacagttcactctcggatggccttagtacaaag

SEQ ID NO: 19171 - DNA, 356 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgttgggacgcaccgggatgttaacggttcagttcactctcggctggcctttgtacttag

SEQ ID NO: 19172 - DNA, 350 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcgtagcccacgagtgcggccaccacgccttcagcgactaccagtggcttgacgacaccgtcggtctcatcttccactccttcctcctcgtcccttacttctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19173 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19174 - DNA, 358 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 19175 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19176 - DNA, 350 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactacaagtggcttgacgacaccgtcggactcatcttccactcctttctcctcgtcccttactcctcctcatcgacgccaccattccaacactggctccctcgagagagacgaagtgttcgtccccaagaagaaatccgacatcaagtggtacggaaagtacctcaacaacccgctaggacgcacggtgatgctaaccgttcagttcactctcggctggcctttgtacttag

SEQ ID NO: 19177 - DNA, 358 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacgggtcagttcactctcggctggcctttgtacttag

SEQ ID NO: 19178 - DNA, 358 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctggaaaagccatcgacgccaccattccaacactggctccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 19179 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19180 - DNA, 340 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcagtcatcgacgccaccattccaacactggctccctcgagagagacgaagtgtttgtccccaagaagaaatccgacatcaagtggtacggaaagtacctcaacaacccgctaggacgcacggtgatgctaaccttccagttcacgctcggctggcctttgtacttag

SEQ ID NO: 19181 - DNA, 358 bp, Artificial
  Mutation in BnaC.FAD2.a introduced by TALE nuclease pair BnFAD2_T02
cctctcctccctcaccctctctcctacttcgcctggcccctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19182 - DNA, 356 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 19183 - DNA, 391 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggtagtgtaggtcgttcgctccaagctgggctgtgtgcacgaatcgacgccaccattccaacactggctccctcgagagagacgaagtgtttgtccccaagaagaagtcagacatcaagtggtacggcaagtacctcaacaaccctttgggacgcaccgtgatgttaacggttcagttcaccctcggctggcctttgtacttag

SEQ ID NO: 19184 - DNA, 352 bp, Artificial
  Mutation in BnaC.FAD2.a introduced by TALE nuclease pair BnFAD2_T02
cctctcctccctcaccctctctcctacttcgcctggcctctctactggcctgccaagggtgcgtcctaaccggcgtctgggtcatagcccacgagtgcggccaccacgccttcagcgactaccagtggcttgacgacaccgtcggtctcctcttccactccttcctcctcgtcccttacttctcctggaagtcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 19185 - DNA, 467 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtcttggtcatagcccacgagtgcggccaccacgccttcagcgactaccagtggcttgacgacaccgtcggtctcatcttccactccttcctcctcgtcccttacttctcctggaagtggaaagcgggcagtgagcgcaacgcaattaagctcgccgcgttgtttcatcaagccttacggtcaccgtaaccagcaaatcaatatcactgtgtggcttcaggccgccagtcatcgacgtcaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19186 - DNA, 349 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 19187 - DNA, 291 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccatcagcgactaccagtggcttgacgacaccgtcggaagactggctccctcgagagagacgaactgtttgtccccaagaagaagtcagacatcaagtggtacggcaagtacctcaacaaccctttgggacgcaccgtgatgttaacggttcagttcactctcggctggcctttgtacttag

SEQ ID NO: 19188 - DNA, 359 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagaagccatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19189 - DNA, 352 bp, Artificial
  Mutation in BnaC.FAD2.a introduced by TALE nuclease pair BnFAD2_T02
gctctcctccctcaccctctctcctacttcgcctggcctctctactgggcctgccaagggcgcgtcctaaccggcgtctgggtcatagcccacgagtgcggccaccacgccttcagcgactaccagtggcttgacgacaccgtcggtctcatcttccactccttcctcctcgtcccttacttctcctgtcatcgacgccaccattccaacactggctccctcgagagagacgaagtgttcgtccccaagaagtaatccgacatcaagtggtacgaaaagtacctcaacgacccgctagcacgctcggtggcgctatccgtaccggtcacgctcggctgccctttgtacttcg

SEQ ID NO: 19190 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19191 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagggcggccaccacgccttcagcgactaccagtggcttgacgacaccgtcggtctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19192 - DNA, 414 bp, Artificial
  Mutation in BnaC.FAD2.a introduced by TALE nuclease pair BnFAD2_T02
cctctcctccctcaccctctctcctacttcgcctcgcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagaccccccagcaggtggaggccatcgccagcaataatggtggcaagcaggcgctggagaggcatcgacgccaccattccaacactggctccctcgagagggatgaagtgttcgtccccaagaagaaatccgacatcaagtggtacgggaagtacctcaacaacccgcgagaacgctcggtgatgctaaccgtccagttcacgctcggctggcctttgtacttag

SEQ ID NO: 19193 - DNA, 331 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttagtacttag

SEQ ID NO: 19194 - DNA, 355 bp, Artificial
  Mutation in BnaC.FAD2.a introduced by TALE nuclease pair BnFAD2_T02
cctctcctccctcaccctctcccttacctcgcctggcccctctactggtcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19195 - DNA, 350 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19196 - DNA, 350 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggcttgacgacaccgtcggtctcatcttccactcctttctcctcgtcccttactcctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19197 - DNA, 360 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccactccttcctcctcgtcccttacttctcctggaagtacgtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggccgtggtacttag

SEQ ID NO: 19198 - DNA, 355 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19199 - DNA, 341 bp, Artificial
  Mutation in BnaC.FAD2.a introduced by TALE nuclease pair BnFAD2_T02
cctctcctccctcaccctctctcctacttcgcctggcctctctactgggcctcccaagggggcttcctacccgccgtctggttcatcccccacgggtgcggcccccacgccttcagcgactaccaggggcttgacgacaccgtccgtctcatcttccactccttcctcctcgtcccttacttctcctggaaattccaacactggctccctcgagagagacgaagtgtttgtccccaagaagaagtcagacatcaagtggtacggcaagtacctcaacaaccctttgggacgcaccgtgatgttaacgtttcagttcactctcgggtggcctttgtacttag

SEQ ID NO: 19200 - DNA, 340 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19201 - DNA, 471 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatacaaataaaacgaaaggaccagtcttgctggcgatggcaagcaggcgctggagacgctggagagcattgttgcccagttatctcgccctgatccggcgttggccgcgttgaccagtcatcgacgccaccattccaacactggctccctcgagagagacgaagtgtttgtccccaagaagaagtcagacatcaagtggtacggcaagtacctctacaacccgctaggacgcacggtgatgctaaccttccagttcacgctcggctgccctttgtacttag

SEQ ID NO: 19202 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgttcgtccccaagaagaaatccgacatcaagtggtacggaaagtacctcaacaacccgctaggacgcacggggatgctaaccgtccagtgcacgctcggctggcctgtgtacttag

SEQ ID NO: 19203 - DNA, 360 bp, Artificial
  Mutation in BnaC.FAD2.a introduced by TALE nuclease pair BnFAD2_T02
cctctcctccctcaccctctcccctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtaagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 19204 - DNA, 336 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcatcgacgccaccattccaacactggctccctcgagagagacgaagtgtttgtccccaagaagaagtcagacatcaagtggtacggcaagtacctcaacaaccctttaggacgcaccgtgatgttaacggttcagttcacgctcggctggcctttgtacttag

SEQ ID NO: 19205 - DNA, 355 bp, Artificial
  Mutation in BnaC.FAD2.a introduced by TALE nuclease pair BnFAD2_T02
cctctcctccctcaccctctcccttacctcgcctggcacctctactgggcctgccaaggctgcgtcctaacgggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19206 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaagtaccgcaacagccctgtgggacgcgccatgaggttaacggttcagttcactctcggctggcctttgtacttag

SEQ ID NO: 19207 - DNA, 345 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaaccggcgtctgggtcatcgcccacgagtgcggccaccacgccttcagcgactaccagtggcttgacgacaccgtcggtctcatcttccactccttcctcctcgtcccttacttctcctggaagtacattccaacactggctccctcgagagagacgaagtgtttgtccccaaggagaagtcagacatcaagtggtacggcaagtacctcaacaaccctttgggacgcaccgtgatgttaacggttcagttcactctcggctggcctttgtacttag

SEQ ID NO: 19208 - DNA, 337 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcttccacagccatcgacgccaccactccaacaccggatccctcgagagggatgaagtgttcgtccccaagaagaaatccgacatcaagtggtacggaaagtacctcaacaacccgcgaggacgcacggtgatgctaaccgtccagttcacgctctgctgccctttgtacttag

SEQ ID NO: 19209 - DNA, 356 bp, Artificial
  Mutation in BnaC.FAD2.a introduced by TALE nuclease pair BnFAD2_T02
cctctcctccctcaccctctatcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactcctacctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19210 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 19211 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 19212 - DNA, 348 bp, Artificial
  Mutation in BnaC.FAD2.a introduced by TALE nuclease pair BnFAD2_T02
cctctcctccctcaccctctctcctacttcgcctggcctctctaatgggcctgacaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacgccaccattccaacaccggatccctcgagagggatgaagttttcgtccccaagaagaaatccgacatcaagtggtacggaatgtaccgcaacaacccgctatgacgcacggtgatgctaaccggccagttcacgctcggctggcctttgtacttag

SEQ ID NO: 19213 - DNA, 350 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttactcctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 19214 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagatacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19215 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcaactaccagtggcttgacgacaccgtcggtctcatcttccactccttcctcctcgtcccttacttctcctggaaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 19216 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacacagtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggtacagttcactctcggctggcctttgtacttag

SEQ ID NO: 19217 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaaacatcgacgccaccattccaacactggctccctcgagagagacgaagtgtttgtccccaagaagaagtcagacatcaagtggtacggcaagtacctcaacaaccctttgggacgcaccgggaggttaacggttcagtgctctctcggctgccattagtacgtag

SEQ ID NO: 19218 - DNA, 329 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctagacgacaccgtcggcctcatcttccactaccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19219 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 19220 - DNA, 467 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtggaaagcgggcagtgagcgcaacgcaattaagctcgccgcgttgtttcatcaagccttacggtcaccgtaaccagcaaatcaatatcactgtgtggcttcaggccgccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactaag

SEQ ID NO: 19221 - DNA, 352 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 19222 - DNA, 362 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19223 - DNA, 340 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcccaccattccaacaccggatccctcgatagggacgaagtgttcgtccccaagaagaaatccgacatcaagtggtacggcaagtacctcaacaacccgctaggacgcacggtgatgctaaccgtccagttcaagctcggctggcctttgtacttag

SEQ ID NO: 19224 - DNA, 329 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggtctcatcttccacttacagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 19225 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtccctacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19226 - DNA, 330 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19227 - DNA, 360 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcagtcatcgacgccaccattccaacactggctccctcgagagggatgaagtgttcgtccccaagaagaaatcccacatcaagtggtacggaaagtacctcagcaacccgctaggacgcccggtgatgctaaccgtccagttcacgctcggctggcctttgtacttag

SEQ ID NO: 19228 - DNA, 354 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19229 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactagctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19230 - DNA, 352 bp, Artificial
  Mutation in BnaC.FAD2.a introduced by TALE nuclease pair BnFAD2_T02
cctctcctccctcaccctctcacttacctctcctggcccctctactgggcctgccaaggctgcgtcctaacgggcctctgggtcatcgcccacgaatgcggccaccacgacttcagcgactaccagtggcttgacgacaccgtcggtctcatcttccactccttcctcctcgtcccttacttctccagtcatcgacgccaccattccaacactggctccctcgagagagacgaagtgtttgtccccaagaagaagtcagacatcaagtggtccggcaagtcccccaccaaccctttgggacgcaccgggaagttaacgcttcatttcactctcggctggcctttgtacttag

SEQ ID NO: 19231 - DNA, 350 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgactaccagtggcttgacgacaccgtcggtctcatcttccactccttcctcctcgtcccttacttctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19232 - DNA, 347 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttatccatgacgccaccattccaacaccggatccctcgatagggacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 19233 - DNA, 357 bp, Artificial
  Mutation in BnaC.FAD2.a introduced by TALE nuclease pair BnFAD2_T02
cctctcctccctcaccctctctcctacttcgcctggcctctctactgggcatgccaagggtgcgttctaaccggcgtctgggtcatagcccacgagtgcggccaccacgccttcagcgactaccagtggcttgacgacaccgtcggtctcctcttccactccttcctcctcgtcccttacttctcctggaaagtcatcgacgcccccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19234 - DNA, 332 bp, Artificial
  Mutation in BnaC.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggcttgacgacaccgtcggtctcatcttccactccttcctcctcgtcccttacttctcctggaagtggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19235 - DNA, 318 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggagagagacgaagtgtttgtccccaagaagaagtcagacatcaagtggtacggcaagtacctcaacaacccggtgggacgcaccgtgatgttaacggttcagttcactctcggctggcctttgtacttag

SEQ ID NO: 19236 - DNA, 291 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaaccggcgtctgggtcatagcccacgagtgcggccaccacgccttcagcgactaccagtggcttgacgacaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19237 - DNA, 310 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaaccctttgggacgcaccgtgatgttaacgggtcagtgcactctcggctggcctttgtacttag

SEQ ID NO: 19238 - DNA, 312 bp, Artificial
  Mutation in BnaC.FAD2.a introduced by TALE nuclease pair BnFAD2_T02
cctctcctccctcaccctctctcctacttcgcctggcccctctactgggcctgccaaggctgcgtcctaacggacctctgggtcatcgcccacgaatgcggccaccacgccttcagcgactaccagtggcttgacgacaccgtcggtctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19239 - DNA, 364 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacaaacagtcatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtactta

SEQ ID NO: 19240 - DNA, 332 bp, Artificial
  Mutation in BnaC.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 19241 - DNA, 399 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtagccgaagtttccaaaaggtcgttgatcaaagctcgccgcgttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 19242 - DNA, 365 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacaaacagtcatcgacgccaccattccaacactggctccctcgagagagacgaagtgtttgtccccaagaagaagtcagacatcaagtggtacggcaagtacctcaacaaccttttgggacgcaccgtgatgttaacggttcagttcactctcggctggcctttgtacttag

SEQ ID NO: 19243 - DNA, 355 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 19244 - DNA, 361 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtattag

SEQ ID NO: 19245 - DNA, 357 bp, Artificial
  Mutation in BnaC.FAD2.a introduced by TALE nuclease pair BnFAD2_T02
ctctcctccctcaccctctctcctacttcgcctagcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtttcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 19246 - DNA, 358 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagagtcatcgacgccaccattccaacactggctccctcgagagagacgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 19247 - DNA, 356 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaaatcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 19248 - DNA, 311 bp, Artificial
  Mutation in BnaC.FAD2.a introduced by TALE nuclease pair BnFAD2_T02
cctctcctccctcaccctctctcctacttcgcctggcctctctcctgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaatcgtctttgtccccaagaagaagtcagacatcaagtggtacggcaagtacctcaacaaccctttgggacgcaccgtgatgttaacggttcggttcactctcggctggcctttgtgcttag

SEQ ID NO: 19249 - DNA, 357 bp, Artificial
  Mutation in BnaC.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 19250 - DNA, 357 bp, Artificial
  Mutation in BnaC.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggcttgacgacgccgtgggcctcgtcttccactccttcctcctcgtcccttacttctcctggaaggtcatcgacgccaccattccaacactggctccctcgagagagacgaagtgtttgtccccaagaagaagtcagacatcaagttgtacggcaagtacctcaacaaccctttgggacgcaccgtgatgttaacggttcagttcactctcggctggcctttgtacttag
